US011198856B2

(12) United States Patent
Duchateau et al.

(10) Patent No.: US 11,198,856 B2
(45) Date of Patent: *Dec. 14, 2021

(54) METHOD FOR THE GENERATION OF COMPACT TALE-NUCLEASES AND USES THEREOF

(71) Applicant: CELLECTIS, Paris (FR)

(72) Inventors: Philippe Duchateau, Draveil (FR); Julien Valton, Charenton le Pont (FR); Claudia Bertonati, Paris (FR); Jean-Charles Epinat, Les Lilas (FR); George H. Silva, Le Plessis Trevis (FR); Alexandre Juillerat, Paris (FR); Marine Beurdeley, Paris (FR)

(73) Assignee: CELLECTIS, Paris (FR)

( * ) Notice: Subject to any disclaimer, the term of this patent is extended or adjusted under 35 U.S.C. 154(b) by 129 days.

This patent is subject to a terminal disclaimer.

(21) Appl. No.: 15/069,672

(22) Filed: Mar. 14, 2016

(65) Prior Publication Data

US 2016/0298098 A1 Oct. 13, 2016

Related U.S. Application Data

(63) Continuation of application No. 13/440,940, filed on Apr. 5, 2012, now Pat. No. 9,315,788.

(60) Provisional application No. 61/472,065, filed on Apr. 5, 2011, provisional application No. 61/496,454, filed on Jun. 13, 2011, provisional application No. 61/499,043, filed on Jun. 20, 2011, provisional application No. 61/499,047, filed on Jun. 20, 2011, provisional application No. 61/533,098, filed on Sep. 9, 2011, provisional application No. 61/533,123, filed on Sep. 9, 2011, provisional application No. 61/579,544, filed on Dec. 22, 2011.

(51) Int. Cl.
| | |
|---|---|
| *C12N 9/16* | (2006.01) |
| *C12N 15/63* | (2006.01) |
| *C07K 14/195* | (2006.01) |
| *C12N 9/22* | (2006.01) |
| *C07K 14/47* | (2006.01) |
| *A61K 38/00* | (2006.01) |
| *C12P 19/34* | (2006.01) |

(52) U.S. Cl.
CPC ............ *C12N 9/16* (2013.01); *C07K 14/195* (2013.01); *C12N 9/22* (2013.01); *C12N 15/63* (2013.01); *A61K 38/00* (2013.01); *C07K 14/4703* (2013.01); *C07K 2319/00* (2013.01); *C07K 2319/07* (2013.01); *C07K 2319/80* (2013.01); *C12P 19/34* (2013.01)

(58) Field of Classification Search
CPC ................................................. C07K 2319/80
See application file for complete search history.

(56) References Cited

U.S. PATENT DOCUMENTS

| | | | |
|---|---|---|---|
| 4,179,337 A | 12/1979 | Davis et al. | |
| 4,683,195 A | 7/1987 | Mullis et al. | |
| 5,006,333 A | 4/1991 | Saifer et al. | |
| 8,586,526 B2 | 11/2013 | Gregory et al. | |
| 9,290,748 B2 * | 3/2016 | Danos ...................... | C12N 9/22 |
| 2011/0158957 A1* | 6/2011 | Bonini ...................... | C12N 9/22 |
| | | | 424/93.7 |
| 2011/0301073 A1* | 12/2011 | Gregory ................. | C12N 15/62 |
| | | | 514/1.1 |
| 2013/0337454 A1 | 12/2013 | Duchateau et al. | |

FOREIGN PATENT DOCUMENTS

| | | |
|---|---|---|
| WO | 2003078619 A1 | 9/2003 |
| WO | 2004031346 A2 | 4/2004 |
| WO | 2004067736 A2 | 8/2004 |
| WO | 2006/097784 A1 | 9/2006 |
| WO | 2006097853 A1 | 9/2006 |
| WO | 2006097854 A1 | 9/2006 |
| WO | 2007034262 A1 | 3/2007 |
| WO | 2007049156 A2 | 5/2007 |
| WO | 2007057781 A2 | 5/2007 |
| WO | 2007060495 A1 | 5/2007 |
| WO | WO-2007049095 A1 * | 5/2007 ............... C12N 9/22 |
| WO | 2007093918 A2 | 8/2007 |

(Continued)

OTHER PUBLICATIONS

Mondino et al. Redirecting the immune response: Role of adoptive T cell therapy. Human Gene Therapy, vol. 21, pp. 533-541, May 2010 (Year: 2010).*
Ochi et al. Requisite considerations for successful adoptive immunotherapy with engineered T-lymophocytes using tumor antigen-specific T-cell receptor gene transfer. Expert Opinion on Biological Therapy, vol. 11, No. 6, pp. 699-713, May 2011 (Year: 2011).*
GenBank Accession No. NG_001333.2, Dec. 2009, printed as pp. 1/60-60/60. (Year: 2009).*
Takeuchi et al. Tapping natural reservoirs of homing endonucleases for targeted gene modification. Proceedings of the National Academy of Sciences, USA, vol. 108, No. 32, pp. 13077-13082, Aug. 2011. (Year: 2011).*

(Continued)

*Primary Examiner* — Jennifer Dunston
(74) *Attorney, Agent, or Firm* — Arrigo, Lee, Guttman & Mouta-Bellum LLP

(57) ABSTRACT

The present invention relates to a method for the generation of compact Transcription Activator-Like Effector Nucleases (TALENS) that can efficiently target and process double-stranded DNA. More specifically, the present invention concerns a method for the creation of TALENs that consist of a single TALE DNA binding domain fused to at least one catalytic domain such that the active entity is composed of a single polypeptide chain for simple and efficient vectorization and does not require dimerization to target a specific single double-stranded DNA target sequence of interest and process DNA nearby the DNA target sequence. The present invention also relates to compact TALENs, vectors, compositions and kits used to implement the method.

22 Claims, 23 Drawing Sheets

Specification includes a Sequence Listing.

(56) References Cited

FOREIGN PATENT DOCUMENTS

| WO | 2008010093 | A2 | 1/2008 | | |
|---|---|---|---|---|---|
| WO | 2008059382 | A2 | 5/2008 | | |
| WO | 2008093249 | A2 | 8/2008 | | |
| WO | 2008102274 | A2 | 8/2008 | | |
| WO | 2008152523 | A1 | 12/2008 | | |
| WO | 2009013622 | A2 | 1/2009 | | |
| WO | 2009019614 | A2 | 2/2009 | | |
| WO | 2009095793 | A1 | 8/2009 | | |
| WO | WO-2011064751 | A1 | * 6/2011 | ............... | C12N 9/22 |
| WO | WO-2014191527 | A1 | * 12/2014 | ............... | C12N 9/22 |

OTHER PUBLICATIONS

Grizot et al. Context dependence between subdomains in the DNA binding interface of the I-CreI homing endonuclease. Nucleic Acids Research, vol. 39, No. 14, pp. 6124-6136, Apr. 10, 2011. (Year: 2011).*

Sather et al. Efficient modification of CCR5 in primary human hematopoietic cells using a megaTAL nuclease and AAV donor template. Science Translational Medicine, vol. 7, No. 307, 307ra156, Sep. 30, 2015, pp. 1-15, including pp. 1/19-19/19 of Supplementary Materials. (Year: 2015).*

Boissel et al. megaTALs: a rare-cleaving nuclease architecture for therapeutic genome engineering. Nucleic Acids Research, vol. 42, No. 4, pp. 2591-2601, 2014, Epub Nov. 26, 2013, including pp. 1/34-34/34 of Supplementary Information. (Year: 2013).*

Bogdanove et al. Engineering and altered protein-DNA recognition specificity. Nucleic Acids Research, vol. 46, No. 10, pp. 4845-4871, Apr. 30, 2018. (Year: 2018).*

Hirata, R. et al., "Targeted Transgene Insertion into Human Chromosomes by Adeno-Associated Virus Vectors", Nat. Biotech. (2002), vol. 20:7, pp. 735-738.

Hsia, K. et al., "DNA Binding and Degradation by the HNH Protein ColE7", Structure (2004); vol. 12, pp. 205-214.

Huang, H. et al., "The conserved asparagine in the HNH motif serves an important structural role in metal finger endonucleases", J. Mol. Biol. (2007), vol. 368:3, pp. 812-821.

Ichiyanagi, K. et al., "Crystal Structure of an Archaeal Intein-Encoded Homing Endonuclease PI-PfuI", J Mol. Biol. (2000), vol. 300:4, pp. 889-901.

Inoue, N. et al., "Introduction of single base substitutions at homologous chromosomal sequences by adeno-associated virus vectors", Mol. Thera: J. Am Soc. Gene Therapy (2001), vol. 3:4, pp. 526-530.

Isalan, M. et al., "Rapid, High-Throughput Engineering of Sequence-Specific Zinc Finger DNA-Binding Proteins" Met. Enzy. (2001), vol. 340, pp. 593-609.

Kalish, J. et al., "Targeted Genome Modification via Triple Helix Formation", Ann NY Acad. Sci. (2005), vol. 1058, pp. 151-161.

Kim, H. J. et al., "Targeted genome editing in human cells with zinc finger nucleases constructed via modular assembly" Genome Research (2009), vol. 19:7, pp. 1279-1288.

Kim, Y. G. et la. "Hybrid Restriction Enzymes: Zinc Finger Fusions to Fok I Cleavage Domain", Proc. Natl. Acad. Sci. USA (1996), vol. 93:3, pp. 1156-1160.

Ku, W. et al., "The Zinc Ion in the HNH Motif of the Endonuclease Domain of Colicin E7 Is Not Required for DNA Binding But Is Essential for DNA Hydrolysis", Nucl. Acids Res. (2002), vol. 30:7, pp. 1670-1680.

Landthaler, M. et al., "The Nicking Homing Endonuclease I.cndot. BasI Is Encoded by a Group I Intron in the DNA Polymerase Gene of the Bacillus Thuringiensis Phage Bastille", Nucleic Acids Research (2003), vol. 31:12, pp. 3071-3077.

Landthaler, M. et al., "Two Self-Splicing Group I Introns in the Ribnucleotide Reductase Large Subunit Gene of Staphylococcus aureus Phage Twort", Nucl. Acids Res. (2002), vol. 30:9, pp. 1935-1943.

Landthaler, M. et al., Group I Intron Homing in Bacillus Phages SpoI and SP82: A Gene Conversion Event Initiated by a Nicking Homing Endonuclease, Journal of Bacteriology (2004), vol. 186:13, pp. 4307-4314.

Landthaler, M., et al., "I-BasI and I-HmuI: Two Phage Intron-Encoded Endonucleases With Homologous DNA Recognition Sequences But Distinct DNA Specificities", J. of Molecular Biology (2006), vol. 358:4, pp. 1137-1151.

Lee, S.E., "Role of yeast SIR genes and mating type in directing DNA double-strand breaks to homologous and non-homologous repair paths", Curr. Biol. (1999), vol. 9:14, pp. 767-770.

Li, T. et al., "TAL nucleases (TALNs): hybrid proteins composed of TAL effectors and FokI DNA-cleavage domain" Nucl. Acids Res. (2011), vol. 39:1, pp. 359-372.

Liang, F. "Homology-directed repair is a major double-strand break repair pathway in mammalian cells", Proc. Natl. Acad. Sci. USA (1998), vol. 95:9, pp. 5172-5177.

Liu et al. Distance determination by GIY-YIG intron endonculeases: discrimination between repression and cleavage function. Nucleic Acids Research, vol. 34, No. 6, pp. 1755-1764, 2006.

Liu, P Q et al., "Generation of a triple-gene knockout mammalian cell line using engineered zinc-fingers", Biotechnology and Bioengineering (2010), vol. 106:1, pp. 97-105.

Liu, Q. et al., "Role of the interdomain linker in distance determination for remote cleavage by homing endonuclease 1-TevI", J. Mol. Biol. (2008), vol. 379:5, pp. 1094-1106.

Lloyd, A. et al., "Targeted mutagenesis using zinc-finger nucleases in *Arabidopsis*", Proc. Natl. Acad. Sci. USA (2005), vol. 102:6, pp. 2232-2237.

Maeder, M. L, et al., "Rapid "open-source" engineering of customized zinc-finger nucleases for highly efficient gene modification", Mol. Cell (2008), vol. 31:2, pp. 294-301.

Mahfouz, M.M. et al., "De novo-engineered transcription activator-like effector (TALE) hybrid nuclease with novel DNA binding specificity creates double-strand breaks", Proc. Natl. Acad. Sci. USA (2011), vol. 108:6, pp. 2623-2628.

Marcalda, M. J. et al., "Horning endonucleases: from basics to therapeutic applications", Cell. Mol. Life Sci. (2010), vol. 67:5, pp. 727-748.

Mashimo, T.A. et al., "Generation of knockout rats with X.cndot. linked severe combined immunodeficiency (X-SCID) using zinc-finger nucleases", PLoS One (2010), vol. 5:1, pp. e8870 (7 pgs).

McConnell Smith, A. et al., "Generation of a nicking enzyme that stimulates site-specific gene conversion from the I-AniI LAGLIDADG homing endonuclease". Proc. Natl. Acad. Sci. USA (2009), vol. 106:13, pp. 5099-5104.

McVey, M. et al., "MMEJ repair of double-strand breaks (director's cut): deleted sequences and alternative endings", Trends in Genetics (2008), vol. 24:11, pp. 529-538.

Menoret, S. et al., "Characterization of Immunoglobulin heavy chain knockout rats", European J. Immunology (2010), vol. 40:10, pp. 2932-2941.

Metzger, M. J. et al., "Single-strand nicks induce homologous recombination with less toxicity than double-strand breaks using an AAV vector template", Nucl. Acids Res. (2011), vol. 39:3, pp. 926-935.

Midon, M. et al., "Mutational and biochemical analysis of the DNA-entry nuclease 15 EndA from *Streptococcus pneumonia*", Nucl. Acids Res. (2011), vol. 39:2, 623-634.

Miller, J. C. et al., "A TALE nuclease architecture for efficient genome editing", Nature Biotech. (2011), vol. 29:2, pp. 143-148.

Mimitou E. P. et al., "Sae2, Exo1 and Sgs1 collaborate in DNA double-strand break processing", Nature (2008), vol. 455:7214, pp. 770-774.

Moore, I., et al. "Transactivated and chemically inducible gene expression in plants", Plant J (2006), vol. 45:4, pp. 651-683.

Moore, J. et al., "Cell cycle and genetic requirements of two pathways of nonhomologous end-joining repair of double-strand breaks in *Saccharomyces cerevisiae*", Mol. Cell Biol. (1996), vol. 16:5, pp. 2164-2173.

Moscou, M. J. et al., "A simple cipher governs DNA recognition by TAL effectors", Science (2009), vol. 326:5959, p. 1501.

(56) References Cited

OTHER PUBLICATIONS

Moure, C. M., et al., "Crystal structure of the intein homing endonuclease PI-SceI bound to its recognition sequence", Nat Struct. Biol. (2002), vol. 9:10, pp. 764-770.
Moure, C. M., et al., "The crystal structure of the gene targeting homing endonuclease I.cndot.SceI reveals the origins of its target site specificity", J Mol. Biol. (2003); vol. 334:4, pp. 685-695.
Nimonkar, A. V. et al., "BLM-DNA2-RPA-MRN and EXO1-BLM-RPA-MRN constitute two DNA end resection machineries for human DNA break repair", Genes Dev (2011), vol. 25:4, pp. 350-362.
Niu, Y. et al., "Engineering variants of the 1-SceI homing endonuclease with strand-specific and site-specific DNA nicking activity", J. Mol. Biol. (2008), vol. 382:1, pp. 188-202.
Orr-Weaver, T. L. et al., "Genetic applications of yeast transformation with linear and gapped plasmids", Met. In Enzy. (1983), vol. 101, pp. 228-245.
Orr-Weaver, T. L. et al., "Yeast transformation: a model system for the study of recombination", Proc. Natl. Acad. Sci. USA (1981), vol. 78:10, pp. 6354-6358.
Pabo, C. O. et al., "Design and selection of novel Cys2His2 zinc finger proteins", Ann. Rev. Biochem. (2001), vol. 70, pp. 313-340.
Padidam, M. "Chemically regulated gene expression in plants", Curr. Opin Plant Biol. (2003), vol. 6:2, pp. 169-177.
Paques, F. et al., "Meganucleases and DNA double-strand break-induced recombination: perspectives for gene therapy", Current Gene Therapy (2007), vol. 7:1, pp. 49-66.
Paques, F. et al., "Multiple pathways of recombination Induced by double-strand breaks in *Saccharomyces cerevisiae*", Micro. Mol. Biol. Rev. (1999), vol. 63:2, pp. 349-404.
Perez, E. E. et al., "Establishment of HIV-1 resistance in CD4+ T cells by genome editing using zinc-finger nucleases", Nat Biotech. (2008), vol. 26:7, pp. 808-816.
Pierce, A .J. et al., "Ku DNA end-binding protein modulates homologous repair of double-strand breaks in mammalian cells", Genes Dev. (2001), vol. 15:24, pp. 3237-3242.
Pingod, A. et al., "Precision genome surgery", Nat Biotech. (2007), vol. 25:7, pp. 743-744.
Porteus, M.H. et al., "Gene targeting using zinc finger nucleases", Nat. Biotech. (2005), vol. 23:8, pp. 967-973.
Potenza, C. et al., "Invited Review: Targeting Transgene Expression in Research, Agricultural and Environmental Applications: Promoters Used in Plant Transformation" in vitro Cell Dev Biol. (2004); vol. 40; pp. 1-22.
Arimondo, P. B. et al. "Exploring the cellular activity of camptothecin-triple-helix-forming oligonucleotide conjugates", Mol. Cell Biol. (2006), vol. 26:1, pp. 324-333.
Arnould, S. et al. "Engineering of large Nos. Of highly specific homing endonucleases that induce recombination on novel DNA targets", J. Mol. Biol. (2006), vol. 355:3, pp. 443-458.
Arnould, S. et al. "The I-CreI meganuclease and its engineered derivatives: applications from cell modification to gene therapy", PEDS (2011), vol. 24:1-2, pp. 27-31.
Arnould, S. et al., "Engineered I-CreI derivatives cleaving sequences from the human XPC gene can induce highly efficient gene correction in mammalian cells", J. Mol. Biol. (2007), vol. 371:1, pp. 49-65.
Ashworth, J. et al., "Computational redesign of endonuclease DNA binding and cleavage specificity", Nature (2006), vol. 441:7093, pp. 656-659.
Bedayat, B. et al., "Sequence-Specific correction of genomic hypoxanthine-guanine phosphoribosyl transferase mutations in lymphoblasts by small fragment homologous replacement", Oligonucleotides (2010), vol. 20:1, pp. 7-16.
Bennardo, N. et al., "Alternative-NHEJ is a mechanistically distinct pathway of mammalian chromosome break repair", PLoS Genet (2008), 4(6), p. e1000110.
Bennardo, N. et al., "Limiting the persistence of a chromosome break diminishes its mutagenic potential", PLoS Genet (2009), vol. 5:10, p. e1000683.

Boch, J. et al., (2009). "Breaking the code of DNA binding specificity of TAL-type III effectors", Science (2009), vol. 326:5959, pp. 1509-1512.
Bolduc, J. M. et al., (2003). "Structural and biochemical analyses of DNA and RNA binding by a bifunctional homing endonuclease and group I intron splicing factor", Genes Dev. (2003), vol. 17:23, pp. 2875-2888.
Buis, J. et al., "Meganuclease activity has essential roles in DNA repair and genomic stability distinct from ATM activation", Cell (2008), vol. 135:1, pp. 85-96.
Capecchi, M. R., "Generating mice with targeted mutations", Nature Medicine (2001), vol. 7:10, pp. 1086-1090.
Carroll, D., "Progress and prospects: Zinc-finger nucleases as gene therapy agents", Gene Therapy (2008), vol. 15:22, pp. 1463-1468.
Chames, P. et al. "In vivo selection of engineered homing endonucleases using double-strand break Induced homologous recombination", Nucleic Acids. Res. (2005), vol. 33:20, pp. e178.
Chan, S. et al., "Natural and engineered nicking endonucleases from cleavage mechanism to engineering of strand-specificity", Nucleic Acids Research (2011), vol. 39, pp. 1-18.
Chevalier, B. et al., "Metal-Dependent DNA Cleavage Mechanism of the I-CreI LAGLIDADG Homing Enodnuclease" Biochem (2004); vol. 43, pp. 14015-14026.
Chevalier, B. S. et al., "Design, activity, and structure of a highly specific artificial endonuclease", Mol. Cell (2002), vol. 10:4, pp. 895-905.
Chevalier, B. S. et al., "The homing endonuclease I-CreI uses three metals, one of which is shared between the two active sites", Nat. Struct. Biol. (2001), vol. 8:4, pp. 312-316.
Chevalier, B. S. et al., (2001). "Homing endonucleases: structural and functional insight into the catalysts of intron/intein mobility", Nucleic Acids Res. (2001), vol. 29:18, pp. 3757-3774.
Chevalier, B. S., et al., "Flexible DNA target site recognition by divergent homing endonuclease isoschizomers ICreI and I-MsoI", J. Mol. Biol. (2003); vol. 329:2, pp. 253-269.
Choo, Y. et al., "Selection of DNA binding sites for zinc fingers using rationality randomized Dna reveals coded interactions", PNAS USA (1994), vol. 91:23, pp. 11168-11172.
Choo, Y. Y et al. "Toward a code for the interactions of zinc fingers with DNA: selection of randomized fingers displayed on phage", PNAS USA (1994), vol. 91:23, pp. 11163-11167.
Choulika, A. et al., "Induction of homologous recombination in mammalian chromosomes by using the I-SceI system of *Saccharomyces cerevisiae*", Mol. Cell Biol. (1995); vol. 15:4, pp. 1968-1973.
Christian, M. et al., (2010). "Targeting DNA, double-strand breaks with TAL effector nucleases", Genetics (2010), 186: 2, pp. 757-761.
Cost, G. J., et al., "BAK and BAX deletion using zinc-finger nucleases yields apoptosis-resistant CHO cells", Biotech. and Bioeng. (2010), vol. 105:2, pp. 330-340.
Delacote, F. et al., (2.008). "Importance of the cell cycle phase for the choice of the appropriate DSB repair pathway, for genome stability maintenance: the trans-S double-strand break repair model", Cell Cycle (2008), vol. 7:1, pp. 33-38.
Doudeva, L G. et al. "Crystal structural analysis and metal-dependent stability and activity studies of the CoIE7 endonuclease domain in complex with DNA/Zn2+ or inhibitor/NI2", Protein Science (2006), vol. 15:2, pp. 269-280.
Doyon, J.B., et al., "Directed Evolution and Substrate Specificity Profile of Homing Endonuclease I-SceI", J. Am. Chem. Soc. (2006), vol. 128:7, pp. 2477-2484.
Doyon, Y. et al., "Heritable targeted gene disruption in zebrafish using designed zinc-finger nucleases", Nature BioTechnology (2008), vol. 26:6, pp. 702-708.
Eastberg, J. H. et al, "Mutability of an HNH Nuclease Imidazole General Base and Exchange of a Deprotonation Mechanism", Biochemistry (2007), vol. 46:24, pp. 7215-7225.
Eisenschmidt, K. et al., "Developing a programmed restriction endonuclease for highly specific DNA cleavage", Nucl. Acids Res. (2005), vol. 33:22, pp. 7039-7047.
Elrod-Erickson, M. et al., "Zif268 Protein-DNA Complex Refined At 1.6 A: A Model System for Understanding Zinc Finger-DNA Interactions", Structure (1996), vol. 4:10, pp. 1171-1180.

(56) References Cited

OTHER PUBLICATIONS

Epinat, J. et al. "A Novel Engineered Meganuclease Induces Homologous Recombination in Yeast and Mammalian Cells", Nucl. Acids Res. (2003), vol. 31:11, pp. 2952-2962.
Frank, K. M. et al., "Late Embryonic Lethality and Impaired V(D)J Recombination in Mice Lacking DNA Ligase IV", Nature (1998), vol. 396:6707, pp. 173-177.
Galetto, R., et al. "Targeted Approaches for Gene Therapy and the Emergence of Engineered Meganucleases", Exp. Opin. Bio Ther. (2009), vol. 9:10, pp. 1289-1303.
Gao, H. et al., "Heritable Targeted Mutagenesis in Maize Using a Designed Endonuclease TPJ4041" The Plant Journal for Cell and Molecular Biology (2010), vol. 61:1, pp. 176-187.
Gao, Y. et al., "A Critical Role for DNA End-Joining Proteins on both Lymphogenesis and Neurogenesis", Cell (1998), vol. 95:7, pp. 891-902.
Geurts, A.M. et al., "Knockout Rats Via Embryo Microinjection of Zinc-Finger Nucleases" Science (2009), vol. 325:5939, p. 433.
Gimble, F. S. et al., "Assessing the Plasticity of DNA Target Site Recognition of the PI-ScelI Homing Endonuclease Using a Bacterial Two-Hybrid Selection System", J. Mol. Bio. (2003), vol. 334:5, pp. 993-1008.
Greisman, H. A., "A general strategy for selecting high-affinity zinc finger proteins for diverse DNA target sites", Science (1997), vol. 275:5300, pp. 657-661.
Grizot, S. et al "Efficient targeting of a SCID gene by an engineered single-chain homing endonuclease" NAR (2009); vol. 37:16, pp. 5405-5149.
Grizot, S. et al. "Generation of Redesignated Homing Endonculeases comprising DNA-binding domains derived from two different scaffolds", NAR (2010); vol. 38:6; pp. 2006-2018.
Gruenert, D.C., et al., "Sequence-Specific Modification of Genomic DNA by Small Fragments", J. Clin. Invest. (2003), vol. 112:5, pp. 637-641.
Guirouilh-Barbat, J et al., "Defects in XRCC4 And KU80 Differentially Affect the Joining of Distal Nonhomologous Ends", Proc. Natl. Acad. Sci. USA (2007), vol. 104:52, pp. 20902-20907.
Guirouilh-Barbat, J., et al. "Impact of the KU80 Pathway on NHEJ-Induced Genome Rearrangements in Mammalian Cells", Mol. Cell (2004), vol. 14:5, pp. 611-623.
Gurlebeck, D. et al., "Dimerization of the bacterial effector protein AvrBs3 in the plant cell cytoplasm prior to nuclear import", The Plant Journal for Cell and Molecular Biology (2005), vol. 42:2, pp. 175:187.
Haber, J. "Alternative Endings", Proc. Ntal. Acad. Sci USA (2008), vol. 105:2, pp. 405-406.
Haber, J., "Partners and pathways repairing a double-strand break", Trends Genet. (2000), vol. 16:6, pp. 259-264.
Hartsuiker, E. et al., Ctp1CtLP and Rad32Mrell nuclease activity are required for Rec12Spo11 removal, but Rec12Spo11 removal is dispensable for other MRN-dependent meiotic functions, Mol. Cell Biol. (2009), vol. 29:7, pp. 1671-1681.
Hinnen, A. et al., "Transformation of Yeast", Proc. Natl. Acad. Sci. USA, (1978), vol. 75:4, pp. 1929-1933.
Ramirez, C. E. et al., "Unexpected failure rates for modular assembly of engineered zinc fingers", Nature Methods (2008). vol. 5:5, pp. 374-375.
Rosen, L.E. et al. "Homing endonuclease I-CreI derivatives with novel DNA target specificities." Nucleic Acids Research (2006) vol. 34:17, pp. 4791-4800.
Rothstein, R. J. "One-step gene disruption in yeast", Methods in Enzymology (1983) vol. 101, pp. 202-211.
Rouet, P. et al., "Expression of a site-specific endonuclease stimulates homologous recombination in mammalian cells", PNAS (1994), vol. 91:13, pp. 6064-6068.
Rouet, P. et al., Introduction of double-strand breaks into the genome of mouse cells by expression of a rare-cutting endonuclease, Mol. Cell Biol. (1994), vol. 14:12, pp. 8096-8106.
Russell, D. W. et al, "Human gene targeting by viral vectors", Nature Genetics (1998), vol. 18:4, pp. 325-330.

Sangiuolo, F. et al., "Cftr gene targeting in mouse embryonic stem cells mediated by Small Fragment Homologous Replacement (SFHR)", Frontiers in Bioscience: A Journal and Virtual Library (2008); vol. 13, pp. 2989-2999.
Santiago, Y. et al., "Targeted gene knockout in mammalian cells by using engineered zinc-finger nucleases", Proc. Natl. Acad. Sci. USA (2008), pp. 5809-5814.
Sartori, A. et al., "Human CtIP promotes DNA end resection", Nature (2007), vol. 450:7169, pp. 509-514.
Seligman, L M. et al., "Genetic analysis of the Chlamydomonas reinhardtil I-CreI mobile intron homing system in *Escherichia coli*", Genetics (1997), vol. 147:4, pp. 1653-1664.
Seligman, L M. et al., Mutations altering the cleavage specificity of a homing endonuclease, Nucl. Acids Res. (2002), vol. 30:17, pp. 3870-3879.
Shen, B. W. et al., "DNA binding and cleavage by tile HNH homing endonuclease I-HmuI", J. Mol. Biol. (2004), vol. 342 1, pp. 43-56.
Shlukla, V. K. et al., "Precise genome modification in the crop species *Zea mays* using zinc-finger nucleases", Nature (2009), vol. 459:7245, pp. 437-441.
Silva, G. H. et al., "Crystal structure of the thermostable archaeal intron-encoded endonuclease 1-DmoI", J. Mol. Biol. (1999), vol. 286:4, pp. 1123-1136.
Simon, P., "Sequence-specific DNA cleavage mediated by bipyridine polyamide conjugates", Nucl. Acids Res. (2008), vol. 36:11, pp. 3531-3538.
Smith, J. et al., "A combinatorial approach to create artificial homing endonucleases cleaving chosen sequences", Nucl. Acids Res. (2006), vol. 34:22, pp. e149.
Smith, J. et al., "Requirements for double-strand cleavage by chimeric restriction enzymes with zinc finger DNA-recognition domains", Nucl. Acids Res. (2000), vol. 28:17, pp. 3361-3369.
Smith, J.J. et al., "A detailed study of the substrate specificity of a chimeric restriction enzyme", Nucl. Acids Res. (1999), vol. 27:2, pp. 674-681.
Sonoda, E. et la., "Differential usage of non-homologous end-joining and homologous recombination in double strand break repair", DNA Repair (2006), vol. 5:9-10, pp. 1021-1029.
Spiegel, P. C, et al., "The structure of 1-CeuI homing endonuclease: Evolving asymmetric DNA recognition from a symmetric protein scaffold", Structure (2006), vol. 14:5, pp. 869-880.
Stoddard, B. L. et al., "Advances in Engineering Homing Endonucleases for Gene Targeting: Ten Years After Structures", Progress in Gene Therapy: Autologous and Cancer Stem Cell Gene Therapy. R. Bertolotti and K. Ozawa, World Scientific PublishingCo. Pte. Ltd, (2007); vol. 3, pp. 135-168.
Stoddard, B. L., et al., "Homing endonuclease structure and function", Q. Rev. Biophys. (2005), vol. 38:1, pp. 49-95. 38(1); 49-95.
Sugawara, N. et al., "Characterization of double-strand break-induced recombination: homology requirements and single-stranded DNA formation", Mol Cell Biol. (1992), vol. 12:2, pp. 563-575.
Sun, H. et al., "Extensive 3'-overhanging, single-stranded DNA associated with the meiosis-specific double-strand breaks at the ARG4 recombination initiation site" Cell (1991), vol. 64:6, pp. 1155-1161.
Sussman, D. et al., "Isolation and characterization of new homing endonuclease specificities at individual target site positions", J. Mol. Biol. (2004), vol. 342:1, pp. 31-41.
Szurek, B. et al., "Type III-dependent translocation of the Xanthomonas AvrBs3 protein into the plant cell", Mol. Biol. (2002); vol. 46:1, pp. 13-23.
Taubes, G. "Gene therapy, The strange case of chimeraplasty", Science (2002), vol. 298:5601, pp. 2116-2220.
Wang, R. et al., "Chemically regulated expression systems and their applications in transgenic plants", Transgenic Res. (2003), vol. 12:5, pp. 529-540.
Wang, Y. et al., "Redesign of high-affinity nonspecific nucleases with altered sequence preference", J. Am. Chem. Soc. (2009), vol. 131:47, pp. 17345 17353.
White, C. et al., "Intermediates of recombination during mating type switching in *Saccharomyces cerevisiae*", Embo J. (1990), vol. 9:3, pp. 663-673.

(56) References Cited

OTHER PUBLICATIONS

Yang, M. et al., "Targeted mutagenesis in the progeny of maize transgenic plants", Plant Mol. Biol. (2009), vol. 70:6, pp. 669-679.
Zhao, L. et al., "The restriction fold turns to the dark side: a bacterial homing endonuclease with a FD-(D/E)-XK motif", The EMBO Journal (2007), vol. 26:9, pp. 2432-2442.
Zuo, J. et al., "Chemical-inducible systems for regulated expression of plant genes", Curr. Opin. Biotech. (2000), vol. 11:2, pp. 146-151.
Fajardo-Sanchez et al., Computer design of obligate heterodimer meganucleases allows efficient cutting of custom DNA sequences, Nucleic Acids Research, 2008, vol. 36, No. 7 2163-2173.
Werner et al., High resolution crystal structure of domain I of the *Saccharomyces cerevisiae* homing endonuclease PI-Scel, Nucleic Acids Research, 2002, vol. 30 No. 18, 3962-3971.
Marcaida et al., Crystal structure of I-Dmol in complex with its target DNA provides new insights into meganuclease engineering, PNAS, 2008, vol. 105 No. 44, 16888-16893.
Munoz et al., Molecular basis of engineered meganuclease targeting of the endogenous human RAG1 locus, Nucleic Acids Research, 2011, vol. 39, No. 2 729-743.
Ashworth et al., Computational reprogramming of homing endonuclease specificity at multiple adjacent base pairs, Nucleic Acids Research, 2010, vol. 38, No. 16 5601-5608.
Baxter et al., Engineering domain fusion chimeras from I-Onul family LAGLIDADG homing endonucleases; Nucleic Acids Research, 2012, vol. 40, No. 16 7985-8000.

\* cited by examiner

I-CreI:
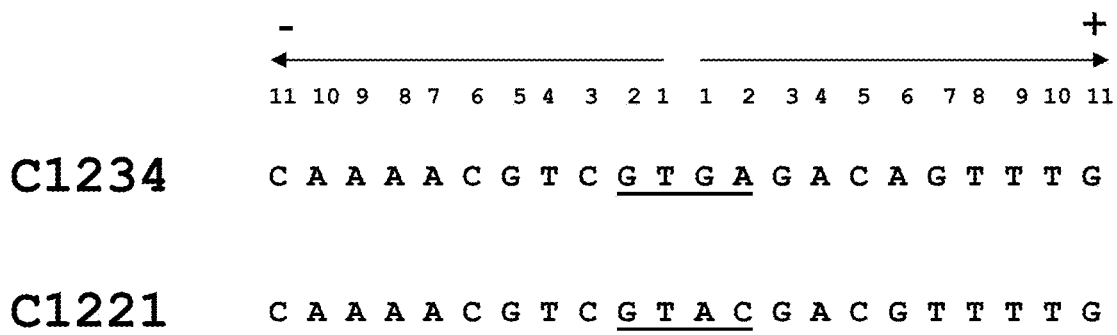
I-TevI:
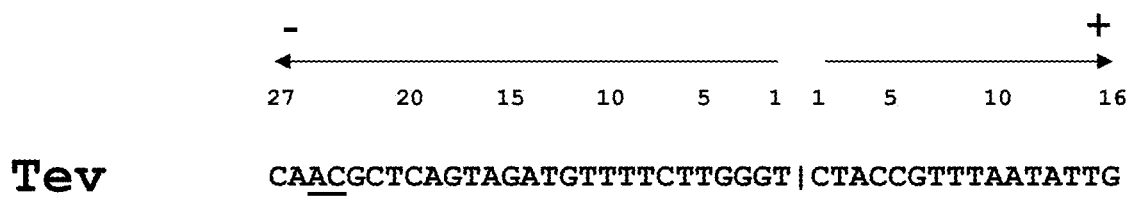
Figure 2

Naturally derived RVDs

AvrBs3

| Wild-type RVD: | | HD | NG | NS | NG | QY | NI | NI | SS | HD | NG | WS | NC | HD | HD | SD | NG | HD | QS |
|---|---|---|---|---|---|---|---|---|---|---|---|---|---|---|---|---|---|---|---|
| Base: | T | A | T | A | T | A | A | A | C | C | T | A | A | C | C | C | T | C | T |
| Cipher RVD: | | NI | QS | NI | NG | QY | NI | NI | QG | NG | QI | NI | HD | HD | QG | HG | HD | HG | QG |
| Position: | -1 | 1 | 2 | 3 | 4 | 5 | 6 | 7 | 8 | 9 | 10 | 11 | 12 | 13 | 14 | 15 | 16 | 17 | 18 |

PthXo1

| Wild-type RVD: | | HD | GG | NI | NG | QI | NG | N* | QI | HD | NI | NG | NI | HI | QS | NG | NS | QY | NI | NI | QS | N* | NS | QG |
|---|---|---|---|---|---|---|---|---|---|---|---|---|---|---|---|---|---|---|---|---|---|---|---|---|
| Base: | T | G | C | A | T | C | T | C | C | C | T | A | C | T | G | T | A | C | A | C | C | A | C |
| Cipher RVD: | | NG | HD | NI | NG | HD | NG | HD | HD | HD | NG | NI | HD | NG | NG | NG | NI | HD | NI | HD | HD | NI | HD |
| Position: | -1 | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 |

Artificial RVDs

RagT2-R

| Base: | T | G | T | T | T | A | T | G | G | T | T | A | C | T | T | A | T |
|---|---|---|---|---|---|---|---|---|---|---|---|---|---|---|---|---|---|
| Cipher RVD: | | NN | QS | NG | NG | QY | NI | NG | NN | NN | NG | NG | QI | HD | NG | NG | NI | NG |
| Position: | -1 | 1 | 2 | 3 | 4 | 5 | 6 | 7 | 8 | 9 | 10 | 11 | 12 | 13 | 14 | 15 | 16 |

NptIIT5-L

| Base: | T | C | C | T | T | G | C | G | C | A | G | C | T | G | T | G | C |
|---|---|---|---|---|---|---|---|---|---|---|---|---|---|---|---|---|---|
| Cipher RVD: | | HD | HD | NG | NG | NN | HD | NN | HD | NI | NN | HD | NG | NN | NG | NN | HD |
| Position: | -1 | 1 | 2 | 3 | 4 | 5 | 6 | 7 | 8 | 9 | 10 | 11 | 12 | 13 | 14 | 15 | 16 |

NptIIT5-R

| Base: | T | A | G | C | A | G | C | C | A | G | T | C | C | C | T | T | C |
|---|---|---|---|---|---|---|---|---|---|---|---|---|---|---|---|---|---|
| Cipher RVD: | | NI | NN | HD | NI | NN | HD | HD | NI | NN | NG | HD | HD | HD | NG | NG | HD |
| Position: | -1 | 1 | 2 | 3 | 4 | 5 | 6 | 7 | 8 | 9 | 10 | 11 | 12 | 13 | 14 | 15 | 16 |

NptIIT6-L

| Base: | T | G | A | A | G | C | G | G | G | A | A | G | G | G | A | C | T |
|---|---|---|---|---|---|---|---|---|---|---|---|---|---|---|---|---|---|
| Cipher RVD: | | NN | QY | NI | NN | HD | NN | NN | NN | NI | NI | NN | NN | NN | QY | HD | NG |
| Position: | -1 | 1 | 2 | 3 | 4 | 5 | 6 | 7 | 8 | 9 | 10 | 11 | 12 | 13 | 14 | 15 | 16 |

NptIIT6-R

| Base: | T | G | A | C | A | G | G | A | G | A | T | C | C | T | G | C | C |
|---|---|---|---|---|---|---|---|---|---|---|---|---|---|---|---|---|---|
| Cipher RVD: | | NN | QY | NI | HD | NI | NN | NN | NI | NN | NI | NG | HD | HD | NG | NN | HD | HD |
| Position: | -1 | 1 | 2 | 3 | 4 | 5 | 6 | 7 | 8 | 9 | 10 | 11 | 12 | 13 | 14 | 15 | 16 |

Generic Cipher RVDs

Fig. 4A 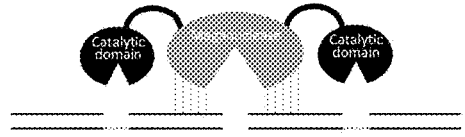

Fig. 4B 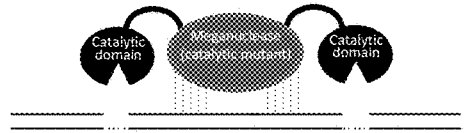

Fig. 4C 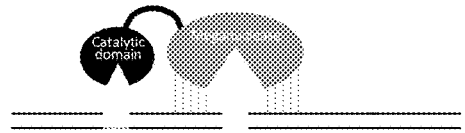

Fig. 4D 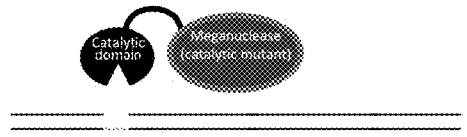

Legend

 - Meganuclease
(can be dimeric or monomeric)

 - Catalytically inactive meganuclease; provides DNA binding specificity
(can be dimeric or monomeric)

 - Region contacting DNA

 - Catalytic domain for DNA strand cleavage
(can be cleavase or nickase domain)

 - Protein linker region

 - Double-strand DNA

 - Single-strand of DNA optionally cleaved depending on the catalytic domain attached

Fig. 5A 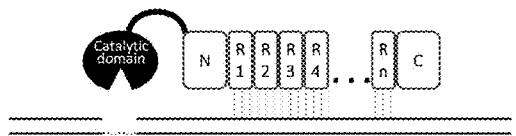

Fig. 5B 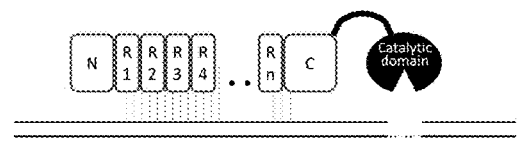

Fig. 5C 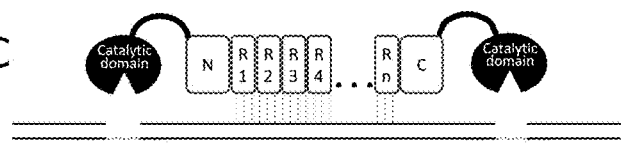

Legend

| N | - TALE protein N-terminal region (including truncations thereof) |
| C | - TALE protein C-terminal region (including truncations thereof) |

- TALE protein repeat region (n = final repeat; depends on construct)

... - Additional TALE repeat regions (for brevity, not shown)

- TALE repeat region contacting DNA

- Catalytic domain for DNA strand cleavage (can be cleavase or nickase domain)

- Protein linker region

- Double-strand DNA

- Single-strand of DNA optionally cleaved depending on the catalytic domain attached

Fig. 6A 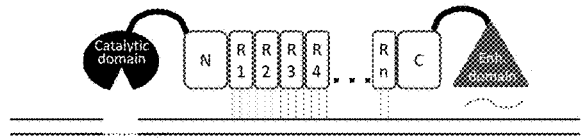

Fig. 6B 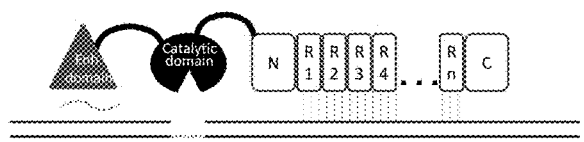

Fig. 6C 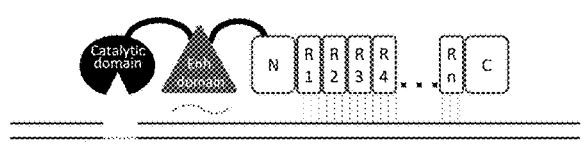

Fig. 6D 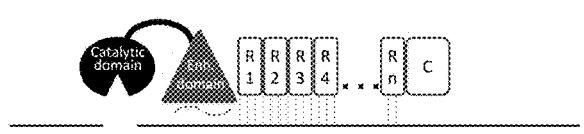

Fig. 6E 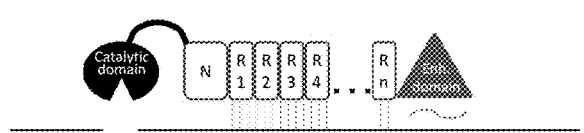

Legend

 - TALE protein N-terminal region (including truncations thereof)

 - TALE protein C-terminal region (including truncations thereof)

 - TALE protein repeat region (n = final repeat; depends on construct)

 - Additional TALE repeat regions (for brevity, not shown)

 - TALE repeat region contacting DNA

 - Enhancer domain; provides functional and/or structural support to scaffold

 - Catalytic domain for DNA strand cleavage (can be cleavase or nickase domain)

 - Protein linker region

 - Double-strand DNA

 - Single-strand of DNA optionally cleaved depending on the catalytic domain attached

Fig. 7A

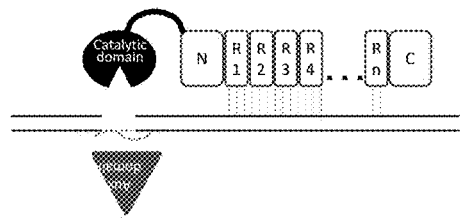

Fig. 7B

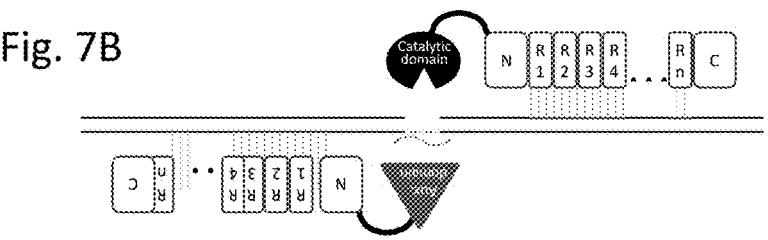

Fig. 7C

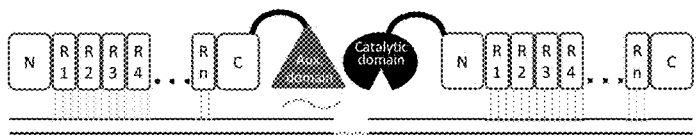

Legend

| | | | |
|---|---|---|---|
| N | - TALE protein N-terminal region (including truncations thereof) | C | - TALE protein C-terminal region (including truncations thereof) |
| R1 | - TALE protein repeat region (n = final repeat; depends on construct) | ... | - Additional TALE repeat regions (for brevity, not shown) |
| | - TALE repeat region contacting DNA | ▲ | -Auxiliary domain; provides optional external functional and/or structural support to scaffold |
| ● | - Catalytic domain for DNA strand cleavage (can be cleavase or nickase domain) | ⌒ | - Protein linker region |
| ─── | - Double-strand DNA | ┈┈ | - Single-strand of DNA optionally cleaved depending on the catalytic domain attached |

| Spacer length [bp] | Neg. Control | cT11Avr_TevD01 | cT11Avr_TevD02 | cT11Avr_TevD05 |
|---|---|---|---|---|
| 5 | n.d. | n.d. | n.d. | n.d. |
| 6 | n.d. | n.d. | n.d. | n.d. |
| 7 | n.d. | n.d. | n.d. | n.d. |
| 8 | n.d. | n.d. | n.d. | n.d. |
| 9 | n.d. | n.d. | n.d. | n.d. |
| 10 | n.d. | + | + | n.d. |
| 11 | n.d. | +++ | + | n.d. |
| 12 | n.d. | + | + | n.d. |
| 13 | n.d. | + | + | n.d. |
| 14 | n.d. | n.d. | n.d. | n.d. |
| 15 | n.d. | +++ | +++ | +++ |
| 16 | n.d. | + | + | + |
| 17 | n.d. | n.d. | n.d. | n.d. |
| 18 | n.d. | n.d. | n.d. | n.d. |
| 19 | n.d. | + | n.d. | n.d. |
| 20 | n.d. | n.d. | n.d. | n.d. |
| 21 | n.d. | + | + | + |
| 22 | n.d. | +++ | +++ | +++ |
| 23 | n.d. | +++ | +++ | +++ |
| 24 | n.d. | +++ | +++ | +++ |
| 25 | n.d. | +++ | +++ | +++ |
| 26 | n.d. | +++ | +++ | +++ |
| 27 | n.d. | +++ | +++ | +++ |
| 28 | n.d. | + | + | n.d. |
| 29 | n.d. | n.d. | n.d. | n.d. |
| 30 | n.d. | n.d. | n.d. | n.d. |

Figure 9

| Spacer length [bp] | pCLS9596 | pCLS9597 | pCLS9599 |
|---|---|---|---|
| 5 | +++ | +++ | +++ |
| 6 | +++ | +++ | +++ |
| 7 | +++ | +++ | +++ |
| 8 | +++ | +++ | +++ |
| 9 | +++ | +++ | +++ |
| 10 | +++ | +++ | +++ |
| 11 | +++ | +++ | +++ |
| 12 | +++ | +++ | +++ |
| 13 | +++ | +++ | +++ |
| 14 | +++ | +++ | +++ |
| 15 | +++ | +++ | +++ |
| 16 | +++ | +++ | +++ |
| 17 | +++ | +++ | +++ |
| 18 | +++ | +++ | +++ |
| 19 | +++ | +++ | +++ |
| 20 | +++ | +++ | +++ |
| 21 | +++ | +++ | +++ |
| 22 | +++ | +++ | +++ |
| 23 | +++ | +++ | +++ |
| 24 | +++ | +++ | +++ |
| 25 | +++ | +++ | +++ |
| 26 | +++ | +++ | +++ |
| 27 | +++ | +++ | +++ |
| 28 | +++ | +++ | +++ |
| 29 | +++ | +++ | +++ |
| 30 | +++ | +++ | +++ |
| 31 | +++ | +++ | +++ |
| 32 | +++ | +++ | +++ |
| 33 | +++ | +++ | +++ |
| 34 | +++ | +++ | +++ |
| 35 | +++ | +++ | +++ |
| 36 | +++ | +++ | +++ |
| 37 | +++ | +++ | +++ |
| 38 | +++ | +++ | +++ |
| 39 | +++ | +++ | +++ |
| 40 | ++ | ++ | +++ |
| compact | +++ | +++ | +++ |
| neg ctrl | n.d. | n.d. | n.d. |

Figure 11

| Spacer length [bp] | pCLS8589 |
|---|---|
| 5 | +++ |
| 6 | +++ |
| 7 | +++ |
| 8 | +++ |
| 9 | +++ |
| 10 | ++ |
| 11 | +++ |
| 12 | +++ |
| 13 | +++ |
| 14 | ++ |
| 15 | ++ |
| 16 | +++ |
| 17 | +++ |
| 18 | +++ |
| 19 | +++ |
| 20 | +++ |
| 21 | ++ |
| 22 | +++ |
| 23 | +++ |
| 24 | +++ |
| 25 | +++ |
| 26 | +++ |
| 27 | +++ |
| 28 | +++ |
| 29 | +++ |
| 30 | +++ |
| 31 | +++ |
| 32 | +++ |
| 33 | +++ |
| 34 | +++ |
| 35 | +++ |
| 36 | +++ |
| 37 | ++ |
| 38 | ++ |
| 39 | ++ |
| 40 | ++ |
| compact | ++ |
| neg ctrl | n.d. |

Figure 12

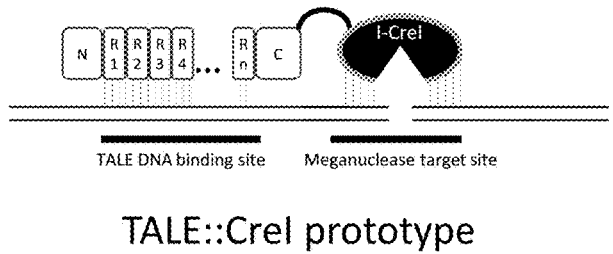

TALE::CreI prototype

TCRB02-A meganuclease target: GATGGCCATGGTAAGCAGGAGGGC

| RVD name | Target sequence | Distance from the TCRB02-A site | RVD motif |
|---|---|---|---|
| TCRB2A1 | TGCTGGTCAGCGCCC | 7 bp | NN-HD-NG-NN-NN-NG-HD-NI-NN-HD-NN-HD-HD-NG |
| TCRB2A2 | TGCTGTGCTGGTCAG | 12bp | NN-HD-NG-NN-NG-NN-HD-NG-NN-NN-NG-HD-NI-NG |
| TCRB2A3 | TGTATGCTGTGCTGG | 16 bp | NN-NG-NI-NG-NN-HD-NG-NN-NG-NN-HD-NG-NN-NG |

| TCRB02 gene region* | GCCAACAGTGTCCTACCAGCAAGGGGTCCTGTCTGCCACCATCCTCT ATGAGATCCTGCTAGGGAAGGCCACCCTGTATGCTGTGCTGGTCAGC GCCCTTGTGTTGATGGCCATGGTAAGCAGGAGGGCAGGATGGGGCCA GCAGGCTGGAGGTGACACACTGACACCAAGCACCCAGAAGTATAGAG TCCCTGCCAGGATTGGAGCTGGGCAGTAGGGA |

*TCRB2A1 and TCRB02-A target sequences underlined for reference

Figure 13

| Targets | Sequence |
|---|---|
| TCRB02.1 | GATGGCCATGGTAAGCAGGAGGGC |
| TCRB02Tsp07 | TGCTGGTCAGCGCCCttgtgttGATGGCCATGGTAAGCAGGAGGGC |
| TCRB02Tsp12 | TGCTGTGCTGGTCAGcgccttgtgttGATGGCCATGGTAAGCAGGAGGGC |
| TCRB02Tsp16 | TGTATGCTGTGCTGGtcagcgccttgtgttGATGGCCATGGTAAGCAGGAGGGC |

| Target | pCLS7185 | pCLS13450 | pCLS15148 |
|---|---|---|---|
| TCRB02.1 | +++ | + | n.d. |
| TCRB02Tsp07 | +++ | + | +++ |
| TCRB02Tsp12 | +++ | ++ | +++ |
| TCRB02Tsp16 | +++ | +++ | +++ |

Figure 14

| Target | pCLS8522+pCLS7763 | pCLS8522+pCLS8990 |
|---|---|---|
| C_N_RAGAvr05 | +++ | ++ |
| C_N_RAGAvr06 | +++ | + |
| C_N_RAGAvr07 | ++ | + |
| C_N_RAGAvr08 | + | n.d. |
| C_N_RAGAvr09 | + | + |
| C_N_RAGAvr10 | + | n.d. |
| C_N_RAGAvr11 | + | n.d. |
| C_N_RAGAvr12 | + | + |
| C_N_RAGAvr13 | + | n.d. |
| C_N_RAGAvr14 | + | + |
| C_N_RAGAvr15 | + | ++ |
| C_N_RAGAvr16 | n.d. | n.d. |
| C_N_RAGAvr17 | n.d. | + |
| C_N_RAGAvr18 | n.d. | ++ |
| C_N_RAGAvr19 | n.d. | ++ |
| C_N_RAGAvr20 | n.d. | ++ |
| C_N_RAGAvr21 | n.d. | ++ |
| C_N_RAGAvr22 | + | +++ |
| C_N_RAGAvr23 | + | +++ |
| C_N_RAGAvr24 | ++ | +++ |
| C_N_RAGAvr25 | + | +++ |
| C_N_RAGAvr26 | + | +++ |
| C_N_RAGAvr27 | + | +++ |
| C_N_RAGAvr28 | + | ++ |
| C_N_RAGAvr29 | + | ++ |
| C_N_RAGAvr30 | +++ | ++ |
| C_N_RAGAvr31 | +++ | +++ |
| C_N_RAGAvr32 | ++ | +++ |
| C_N_RAGAvr33 | ++ | ++ |
| C_N_RAGAvr34 | +++ | +++ |
| C_N_RAGAvr35 | +++ | +++ |
| C_N_RAGAvr36 | +++ | +++ |
| C_N_RAGAvr37 | +++ | +++ |
| C_N_RAGAvr38 | + | ++ |
| C_N_RAGAvr39 | + | + |
| C_N_RAGAvr40 | n.d. | n.d. |
| neg ctrl | n.d. | n.d. |

Figure 18

| spacer length [bp] | pCLS9081 | pCLS9082 |
|---|---|---|
| 40 | + | + |
| 39 | + | + |
| 38 | + | n.d. |
| 37 | + | n.d. |
| 36 | + | +/- |
| 35 | + | + |
| 34 | + | + |
| 33 | + | + |
| 32 | + | + |
| 31 | + | + |
| 30 | + | + |
| 29 | + | + |
| 28 | + | +/- |
| 27 | + | + |
| 26 | + | + |
| 25 | + | + |
| 24 | + | + |
| 23 | + | + |
| 22 | + | + |
| 21 | + | + |
| 20 | + | + |
| 19 | + | + |
| 18 | + | + |
| 17 | + | + |
| 16 | + | + |
| 15 | + | + |
| 14 | n.d. | +/- |
| 13 | + | + |
| 12 | + | +/- |
| 11 | + | +/- |
| 10 | + | n.d. |
| 09 | + | n.d. |
| 08 | + | +/- |
| 07 | + | + |
| 06 | + | + |
| 05 | + | + |
| Compact | + | +/- |

Figure 19

| Catalytic head SeqID | polypeptide linker SeqID | Spacer length [bp] | | | | Compact |
|---|---|---|---|---|---|---|
| | | 15 | 18 | 21 | 24 | |
| 11 | 385 | ++ | ++ | +++ | +++ | ++ |
| 11 | 388 | +++ | +++ | ++ | +++ | ++ |
| 11 | 394 | ++ | +++ | ++ | +++ | ++ |
| 11 | 400 | +++ | +++ | +++ | +++ | ++ |

Figure 20

| Target name | Nucleic acid Target Sequence |
|---|---|
| Avr05 | TATATAAACCTAACCCTCTAGGTAAGAGGGTTAGGTTTATATA |
| Avr06 | TATATAAACCTAACCCTCTAAGGTAAGAGGGTTAGGTTTATATA |
| Avr07 | TATATAAACCTAACCCTCTAAGGTACAGAGGGTTAGGTTTATATA |
| Avr08 | TATATAAACCTAACCCTCTGAAGGTACAGAGGGTTAGGTTTATATA |
| Avr09 | TATATAAACCTAACCCTCTGAAGGTACCAGAGGGTTAGGTTTATATA |
| Avr10 | TATATAAACCTAACCCTCTTGAAGGTACCAGAGGGTTAGGTTTATATA |
| Avr11 | TATATAAACCTAACCCTCTTGAAGGTACCTAGAGGGTTAGGTTTATATA |
| Avr12 | TATATAAACCTAACCCTCTATGAAGGTACCTAGAGGGTTAGGTTTATATA |
| Avr13 | TATATAAACCTAACCCTCTATGAAGGTACCTTAGAGGGTTAGGTTTATATA |
| Avr14 | TATATAAACCTAACCCTCTCATGAAGGTACCTTAGAGGGTTAGGTTTATATA |
| AVR15 | TATATAAACCTAACCCTCTTAGCATGAAGGTACCAGAGGGTTAGGTTTATATA |
| Avr16 | TATATAAACCTAACCCTCTGCATGAAGGTACCTTGAGAGGGTTAGGTTTATATA |
| Avr17 | TATATAAACCTAACCCTCTGCATGAAGGTACCTTGTAGAGGGTTAGGTTTATATA |
| Avr18 | TATATAAACCTAACCCTCTAGCATGAAGGTACCTTGTAGAGGGTTAGGTTTATATA |
| Avr19 | TATATAAACCTAACCCTCTAGCATGAAGGTACCTTGTCAGAGGGTTAGGTTTATATA |
| Avr20 | TATATAAACCTAACCCTCTTAGCATGAAGGTACCTTGTCAGAGGGTTAGGTTTATATA |
| Avr21 | TATATAAACCTAACCCTCTTAGCATGAAGGTACCTTGTCGAGAGGGTTAGGTTTATATA |
| Avr22 | TATATAAACCTAACCCTCTTAGCATGAAGGTACCTTGTCGTAGAGGGTTAGGTTTATATA |
| Avr23 | TATATAAACCTAACCCTCTCTAGCATGAAGGTACCTTGTCGTAGAGGGTTAGGTTTATATA |
| Avr24 | TATATAAACCTAACCCTCTCTAGCATGAAGGTACCTTGTCGTTAGAGGGTTAGGTTTATATA |
| Avr25 | TATATAAACCTAACCCTCTACTAGCATGAAGGTACCTTGTCGTTAGAGGGTTAGGTTTATATA |
| Avr26 | TATATAAACCTAACCCTCTACTAGCATGAAGGTACCTTGTCGTTGAGAGGGTTAGGTTTATATA |
| Avr27 | TATATAAACCTAACCCTCTCACTAGCATGAAGGTACCTTGTCGTTGAGAGGGTTAGGTTTATATA |
| Avr28 | TATATAAACCTAACCCTCTCACTAGCATGAAGGTACCTTGTCGTTGAAGAGGGTTAGGTTTATATA |
| Avr29 | TATATAAACCTAACCCTCTCCACTAGCATGAAGGTACCTTGTCGTTGAAGAGGGTTAGGTTTATATA |
| Avr30 | TATATAAACCTAACCCTCTCCACTAGCATGAAGGTACCTTGTCGTTGATAGAGGGTTAGGTTTATATA |
| Avr31 | TATATAAACCTAACCCTCTACCACTAGCATGAAGGTACCTTGTCGTTGATAGAGGGTTAGGTTTATATA |
| Avr32 | TATATAAACCTAACCCTCTACCACTAGCATGAAGGTACCTTGTCGTTGATTAGAGGGTTAGGTTTATATA |
| Avr33 | TATATAAACCTAACCCTCTGACCACTAGCATGAAGGTACCTTGTCGTTGATTAGAGGGTTAGGTTTATATA |
| Avr34 | TATATAAACCTAACCCTCTGACCACTAGCATGAAGGTACCTTGTCGTTGATTCAGAGGGTTAGGTTTATATA |
| Avr35 | TATATAAACCTAACCCTCTTGACCACTAGCATGAAGGTACCTTGTCGTTGATTCAGAGGGTTAGGTTTATATA |
| Avr36 | TATATAAACCTAACCCTCTTGACCACTAGCATGAAGGTACCTTGTCGTTGATTCAAGAGGGTTAGGTTTATATA |
| Avr37 | TATATAAACCTAACCCTCTCTGACCACTAGCATGAAGGTACCTTGTCGTTGATTCAAGAGGGTTAGGTTTATATA |
| Avr38 | TATATAAACCTAACCCTCTCTGACCACTAGCATGAAGGTACCTTGTCGTTGATTCAGAGAGGGTTAGGTTTATATA |
| Avr39 | TATATAAACCTAACCCTCTTCTGACCACTAGCATGAAGGTACCTTGTCGTTGATTCAGAGAGGGTTAGGTTTATATA |
| Avr40 | TATATAAACCTAACCCTCTTCTGACCACTAGCATGAAGGTACCTTGTCGTTGATTCAGTAGAGGGTTAGGTTTATATA |

Figure 21

| Target name | Nucleic acid Target Sequence |
|---|---|
| Avr05 | TATATAAACCTAACCCTCTAGGTAAGAGGGTTAGGTTTATATA |
| Avr06 | TATATAAACCTAACCCTCTAAGGTAAGAGGGTTAGGTTTATATA |
| Avr07 | TATATAAACCTAACCCTCTAAGGTACAGAGGGTTAGGTTTATATA |
| Avr08 | TATATAAACCTAACCCTCTGAAGGTACAGAGGGTTAGGTTTATATA |
| Avr09 | TATATAAACCTAACCCTCTGAAGGTACCAGAGGGTTAGGTTTATATA |
| Avr10 | TATATAAACCTAACCCTCTTGAAGGTACCAGAGGGTTAGGTTTATATA |
| Avr11 | TATATAAACCTAACCCTCTTGAAGGTACCTAGAGGGTTAGGTTTATATA |
| Avr12 | TATATAAACCTAACCCTCTATGAAGGTACCTAGAGGGTTAGGTTTATATA |
| Avr13 | TATATAAACCTAACCCTCTATGAAGGTACCTTAGAGGGTTAGGTTTATATA |
| Avr14 | TATATAAACCTAACCCTCTCATGAAGGTACCTTAGAGGGTTAGGTTTATATA |
| AVR15 | TATATAAACCTAACCCTCTTAGCATGAAGGTACCAGAGGGTTAGGTTTATATA |
| Avr16 | TATATAAACCTAACCCTCTGCATGAAGGTACCTTGAGAGGGTTAGGTTTATATA |
| Avr17 | TATATAAACCTAACCCTCTGCATGAAGGTACCTTGTAGAGGGTTAGGTTTATATA |
| Avr18 | TATATAAACCTAACCCTCTAGCATGAAGGTACCTTGTAGAGGGTTAGGTTTATATA |
| Avr19 | TATATAAACCTAACCCTCTAGCATGAAGGTACCTTGTCAGAGGGTTAGGTTTATATA |
| Avr20 | TATATAAACCTAACCCTCTTAGCATGAAGGTACCTTGTCAGAGGGTTAGGTTTATATA |
| Avr21 | TATATAAACCTAACCCTCTTAGCATGAAGGTACCTTGTCGAGAGGGTTAGGTTTATATA |
| Avr22 | TATATAAACCTAACCCTCTTAGCATGAAGGTACCTTGTCGTAGAGGGTTAGGTTTATATA |
| Avr23 | TATATAAACCTAACCCTCTCTAGCATGAAGGTACCTTGTCGTAGAGGGTTAGGTTTATATA |
| Avr24 | TATATAAACCTAACCCTCTCTAGCATGAAGGTACCTTGTCGTTAGAGGGTTAGGTTTATATA |
| Avr25 | TATATAAACCTAACCCTCTACTAGCATGAAGGTACCTTGTCGTTAGAGGGTTAGGTTTATATA |
| Avr26 | TATATAAACCTAACCCTCTACTAGCATGAAGGTACCTTGTCGTTGAGAGGGTTAGGTTTATATA |
| Avr27 | TATATAAACCTAACCCTCTCACTAGCATGAAGGTACCTTGTCGTTGAGAGGGTTAGGTTTATATA |
| Avr28 | TATATAAACCTAACCCTCTCACTAGCATGAAGGTACCTTGTCGTTGAAGAGGGTTAGGTTTATATA |
| Avr29 | TATATAAACCTAACCCTCTCCACTAGCATGAAGGTACCTTGTCGTTGAAGAGGGTTAGGTTTATATA |
| Avr30 | TATATAAACCTAACCCTCTCCACTAGCATGAAGGTACCTTGTCGTTGATAGAGGGTTAGGTTTATATA |
| Avr31 | TATATAAACCTAACCCTCTACCACTAGCATGAAGGTACCTTGTCGTTGATAGAGGGTTAGGTTTATATA |
| Avr32 | TATATAAACCTAACCCTCTACCACTAGCATGAAGGTACCTTGTCGTTGATTAGAGGGTTAGGTTTATATA |
| Avr33 | TATATAAACCTAACCCTCTGACCACTAGCATGAAGGTACCTTGTCGTTGATTAGAGGGTTAGGTTTATATA |
| Avr34 | TATATAAACCTAACCCTCTGACCACTAGCATGAAGGTACCTTGTCGTTGATTCAGAGGGTTAGGTTTATATA |
| Avr35 | TATATAAACCTAACCCTCTTGACCACTAGCATGAAGGTACCTTGTCGTTGATTCAGAGGGTTAGGTTTATATA |
| Avr36 | TATATAAACCTAACCCTCTTGACCACTAGCATGAAGGTACCTTGTCGTTGATTCAAGAGGGTTAGGTTTATATA |
| Avr37 | TATATAAACCTAACCCTCTCTGACCACTAGCATGAAGGTACCTTGTCGTTGATTCAAGAGGGTTAGGTTTATATA |
| Avr38 | TATATAAACCTAACCCTCTCTGACCACTAGCATGAAGGTACCTTGTCGTTGATTCAGAGAGGGTTAGGTTTATATA |
| Avr39 | TATATAAACCTAACCCTCTTCTGACCACTAGCATGAAGGTACCTTGTCGTTGATTCAGAGAGGGTTAGGTTTATATA |
| Avr40 | TATATAAACCTAACCCTCTTCTGACCACTAGCATGAAGGTACCTTGTCGTTGATTCAGTAGAGGGTTAGGTTTATATA |
| compact | TATATAAACCTAACCCTCTTAGCATGAAGGTACCTTGTCGATGGTGTACAGTAGGGGGAGATGCA |
| neg. Ctrl. | TTGTTCTCAGGTACCTCAGCCAGA |

Figure 22

| Target name | Nucleic acid Target Sequence |
|---|---|
| C_N_RAGAvr05 | TGTTTATGGTTACTTATaggtaTATATAAACCTAACCCTCT |
| C_N_RAGAvr06 | TGTTTATGGTTACTTATaaggtaTATATAAACCTAACCCTCT |
| C_N_RAGAvr07 | TGTTTATGGTTACTTATaaggtacTATATAAACCTAACCCTCT |
| C_N_RAGAvr08 | TGTTTATGGTTACTTATgaaggtacTATATAAACCTAACCCTCT |
| C_N_RAGAvr09 | TGTTTATGGTTACTTATgaaggtaccTATATAAACCTAACCCTCT |
| C_N_RAGAvr10 | TGTTTATGGTTACTTATtgaaggtaccTATATAAACCTAACCCTCT |
| C_N_RAGAvr11 | TGTTTATGGTTACTTATtgaaggtacctTATATAAACCTAACCCTCT |
| C_N_RAGAvr12 | TGTTTATGGTTACTTATatgaaggtacctTATATAAACCTAACCCTCT |
| C_N_RAGAvr13 | TGTTTATGGTTACTTATatgaaggtaccttTATATAAACCTAACCCTCT |
| C_N_RAGAvr14 | TGTTTATGGTTACTTATcatgaaggtaccttTATATAAACCTAACCCTCT |
| C_N_RAGAvr15 | TGTTTATGGTTACTTATtagcatgaaggtaccTATATAAACCTAACCCTCT |
| C_N_RAGAvr16 | TGTTTATGGTTACTTATgcatgaaggtaccttgTATATAAACCTAACCCTCT |
| C_N_RAGAvr17 | TGTTTATGGTTACTTATgcatgaaggtaccttgtTATATAAACCTAACCCTCT |
| C_N_RAGAvr18 | TGTTTATGGTTACTTATagcatgaaggtaccttgtTATATAAACCTAACCCTCT |
| C_N_RAGAvr19 | TGTTTATGGTTACTTATagcatgaaggtaccttgtcTATATAAACCTAACCCTCT |
| C_N_RAGAvr20 | TGTTTATGGTTACTTATtagcatgaaggtaccttgtcTATATAAACCTAACCCTCT |
| C_N_RAGAvr21 | TGTTTATGGTTACTTATtagcatgaaggtaccttgtcgTATATAAACCTAACCCTCT |
| C_N_RAGAvr22 | TGTTTATGGTTACTTATtagcatgaaggtaccttgtcgtTATATAAACCTAACCCTCT |
| C_N_RAGAvr23 | TGTTTATGGTTACTTATctagcatgaaggtaccttgtcgtTATATAAACCTAACCCTCT |
| C_N_RAGAvr24 | TGTTTATGGTTACTTATctagcatgaaggtaccttgtcgttTATATAAACCTAACCCTCT |
| C_N_RAGAvr25 | TGTTTATGGTTACTTATactagcatgaaggtaccttgtcgttTATATAAACCTAACCCTCT |
| C_N_RAGAvr26 | TGTTTATGGTTACTTATactagcatgaaggtaccttgtcgttgTATATAAACCTAACCCTCT |
| C_N_RAGAvr27 | TGTTTATGGTTACTTATcactagcatgaaggtaccttgtcgttgTATATAAACCTAACCCTCT |
| C_N_RAGAvr28 | TGTTTATGGTTACTTATcactagcatgaaggtaccttgtcgttgaTATATAAACCTAACCCTCT |
| C_N_RAGAvr29 | TGTTTATGGTTACTTATccactagcatgaaggtaccttgtcgttgaTATATAAACCTAACCCTCT |
| C_N_RAGAvr30 | TGTTTATGGTTACTTATccactagcatgaaggtaccttgtcgttgatTATATAAACCTAACCCTCT |
| C_N_RAGAvr31 | TGTTTATGGTTACTTATaccactagcatgaaggtaccttgtcgttgatTATATAAACCTAACCCTCT |
| C_N_RAGAvr32 | TGTTTATGGTTACTTATaccactagcatgaaggtaccttgtcgttgattTATATAAACCTAACCCTCT |
| C_N_RAGAvr33 | TGTTTATGGTTACTTATgaccactagcatgaaggtaccttgtcgttgattTATATAAACCTAACCCTCT |
| C_N_RAGAvr34 | TGTTTATGGTTACTTATgaccactagcatgaaggtaccttgtcgttgattcTATATAAACCTAACCCTCT |
| C_N_RAGAvr35 | TGTTTATGGTTACTTATtgaccactagcatgaaggtaccttgtcgttgattcTATATAAACCTAACCCTCT |
| C_N_RAGAvr36 | TGTTTATGGTTACTTATtgaccactagcatgaaggtaccttgtcgttgattcaTATATAAACCTAACCCTCT |
| C_N_RAGAvr37 | TGTTTATGGTTACTTATctgaccactagcatgaaggtaccttgtcgttgattcaTATATAAACCTAACCCTCT |
| C_N_RAGAvr38 | TGTTTATGGTTACTTATctgaccactagcatgaaggtaccttgtcgttgattcagTATATAAACCTAACCCTCT |

METHOD FOR THE GENERATION OF COMPACT TALE-NUCLEASES AND USES THEREOF

SEQUENCE LISTING

The instant application contains a Sequence Listing which has been submitted electronically in ASCII format and is hereby incorporated by reference in its entirety. Said ASCII copy, created on May 1, 2018, is named 15069672_seq.txt and is 1,621,462 bytes in size.

FIELD OF THE INVENTION

The present invention relates to a method for the generation of compact Transcription Activator-Like Effector Nucleases (TALENs) that can efficiently target and process double-stranded DNA. More specifically, the present invention concerns a method for the creation of TALENs that consist of a single TALE DNA binding domain fused to at least one catalytic domain such that the active entity is composed of a single polypeptide chain for simple and efficient vectorization and does not require dimerization to target a specific single double-stranded DNA target sequence of interest and process DNA nearby said DNA target sequence. The present invention also relates to compact TALENs, vectors, compositions and kits used to implement the method.

BACKGROUND OF THE INVENTION

Mammalian genomes constantly suffer from various types of damage, of which double-strand breaks (DSBs) are considered the most dangerous (Haber 2000). Repair of DSBs can occur through diverse mechanisms that can depend on cellular context. Repair via homologous recombination (HR) is able to restore the original sequence at the break. Because of its strict dependence on extensive sequence homology, this mechanism is suggested to be active mainly during the S and G2 phases of the cell cycle where the sister chromatids are in close proximity (Sonoda, Hochegger et al. 2006). Single-strand annealing (SSA) is another homology-dependent process that can repair DSBs between direct repeats and thereby promotes deletions (Paques and Haber 1999). Finally, non-homologous end joining (NHEJ) of DNA is a major pathway for the repair of DSBs that can function throughout the cell cycle and does not depend on homologous recombination (Moore and Haber 1996; Haber 2008). NHEJ seems to comprise at least two different components: (i) a pathway that consists mostly in the direct re-joining of DSB ends, and which depends on the XRCC4, Lig4 and Ku proteins, and; (ii) an alternative NHEJ pathway, which does not depend on XRCC4, Lig4 and Ku, and is especially error-prone, resulting mostly in deletions, with the junctions occurring between micro-homologies (Frank, Sekiguchi et al. 1998; Gao, Sun et al. 1998; Guirouilh-Barbat, Huck et al. 2004; Guirouilh-Barbat, Rass et al. 2007; Haber 2008; McVey and Lee 2008).

Homologous gene targeting (HGT), first described over 25 years ago (Hinnen, Hicks et al. 1978; Orr-Weaver, Szostak et al. 1981; Orr-Weaver, Szostak et al. 1983; Rothstein 1983), was one of the first methods for rational genome engineering and remains to this day a standard for the generation of engineered cells or knock-out mice (Capecchi 2001). An inherently low efficiency has nevertheless prevented it from being used as a routine protocol in most cell types and organisms. To address these issues, an extensive assortment of rational approaches has been proposed with the intent of achieving greater than 1% targeted modifications. Many groups have focused on enhancing the efficacy of HGT, with two major disciplines having become apparent: (i) so-called "matrix optimization" methods, essentially consisting of modifying the targeting vector structure to achieve maximal efficacy, and; (ii) methods involving additional effectors to stimulate HR, generally sequence-specific endonucleases. The field of matrix optimization has covered a wide range of techniques, with varying degrees of success (Russell and Hirata 1998; Inoue, Dong et al. 2001; Hirata, Chamberlain et al. 2002; Taubes 2002; Gruenert, Bruscia et al. 2003; Sangiuolo, Scaldaferri et al. 2008; Bedayat, Abdolmohamadi et al. 2010). Stimulation of HR via nucleases, on the other hand, has repeatedly proven efficient (Paques and Duchateau 2007; Carroll 2008).

For DSBs induced by biological reagents, e.g. meganucleases, ZFNs and TALENs (see below), which cleave DNA by hydrolysis of two phosphodiester bonds, the DNA can be rejoined in a seamless manner by simple re-ligation of the cohesive ends. Alternatively, deleterious insertions or deletions (indels) of various sizes can occur at the breaks, eventually resulting in gene inactivation (Liang, Han et al. 1998; Lloyd, Plaisier et al. 2005; Doyon, McCammon et al. 2008; Perez, Wang et al. 2008; Santiago, Chan et al. 2008; Kim, Lee et al. 2009; Yang, Djukanovic et al. 2009). The nature of this process, which does not rely on site-specific or homologous recombination, gives rise to a third targeted approach based on endonuclease-induced mutagenesis. This approach, as well as the related applications, may be simpler than those based on homologous recombination in that (a) one does not need to introduce a repair matrix, and; (b) efficacy will be less cell-type dependent (in contrast to HR, NHEJ is probably active throughout the cell cycle (Delacote and Lopez 2008). Targeted mutagenesis based on NEHJ has been used to trigger inactivation of single or even multiple genes in immortalized cell lines (Cost, Freyvert et al. 2010; Liu, Chan et al. 2010). In addition, this method opens new perspectives for organisms in which the classical HR-based gene knock-out methods have proven inefficient, or at least difficult to establish (Doyon, McCammon et al. 2008; Geurts, Cost et al. 2009; Shukla, Doyon et al. 2009; Yang, Djukanovic et al. 2009; Gao, Smith et al. 2010; Mashimo, Takizawa et al. 2010; Menoret, Iscache et al. 2010).

Over the last 15 years, the use of meganucleases to successfully induce gene targeting has been well documented, starting from straightforward experiments involving wild-type I-SceI to more refined work involving completely re-engineered enzymes (Stoddard, Scharenberg et al. 2007; Galetto, Duchateau et al. 2009; Marcaida, Munoz et al. 2010; Arnould, Delenda et al. 2011). Meganucleases, also called homing endonucleases (HEs), can be divided into five families based on sequence and structure motifs: LAGLIDADG, GIY-YIG, HNH, His-Cys box and PD-(D/E)XK (Stoddard 2005; Zhao, Bonocora et al. 2007). Structural data are available for at least one member of each family. The most well studied family is that of the LAGLIDADG proteins, with a considerable body of biochemical, genetic and structural work having established that these endonucleases could be used as molecular tools (Stoddard, Scharenberg et al. 2007; Arnould, Delenda et al. 2011). Member proteins are composed of domains that adopt a similar appappa fold, with the LAGLIDADG motif comprising the terminal region of the first helix and not only contributing to a bipartite catalytic center but also forming the core subunit/subunit interaction (Stoddard 2005). Two such $\alpha/\beta$ domains assemble to form the functional protein, with the $\beta$-strands in each creating a saddle-shaped DNA binding region. The spatial separation of the catalytic center with regions directly interacting with the DNA has allowed for specificity re-engineering (Seligman, Chisholm et al. 2002; Sussman, Chadsey et al. 2004; Arnould, Chames et al. 2006; Doyon, Pattanayak et al. 2006; Rosen, Morrison et al. 2006; Smith, Grizot et al. 2006; Arnould, Perez et al. 2007). In addition, whereas all known LAGLIDADG proteins analyzed to date act as "cleavases" to cut both strands of the target DNA, recent progress has been made in generating "mega-nickases" that cleave only one strand (Niu, Tenney et al. 2008; McConnell Smith, Takeuchi et al. 2009). Such enzymes can in principle provide similar levels of targeted induced HR with a minimization in the frequency of NHEJ.

Although numerous engineering efforts have focused on LAGLIDADG HEs, members from two other families, GIY-YIG and HNH, are of particular interest. Biochemical and structural studies have established that in both families, member proteins can adopt a bipartite fold with distinct functional domains: (1) a catalytic domain responsible mainly for DNA cleavage, and; (2) a DNA-binding domain to provide target specificity (Stoddard 2005; Marcaida, Munoz et al. 2010). The related GIY-YIG HEs I-TevI and I-BmoI have been exploited to demonstrate the interchangeability of the DNA-binding region for these enzymes (Liu, Derbyshire et al. 2006). Analysis of the I-BasI HE revealed that although the N-terminal catalytic domain belongs to the HNH family, the C-terminal DNA-binding region resembles the intron-encoded endonuclease repeat motif (IENR1) found in endonucleases of the GIY-YIG family (Landthaler and Shub 2003). The catalytic head of I-BasI has sequence similarity to those of the HNH HEs I-HmuI, I-HmuII and I-TwoI, all of which function as strand-specific nickases (Landthaler, Begley et al. 2002; Landthaler and Shub 2003; Landthaler, Lau et al. 2004; Shen, Landthaler et al. 2004; Landthaler, Shen et al. 2006).

Whereas the above families of proteins contain sequence-specific nucleases, the HNH motif has also been identified in nonspecific nucleases such the *E. coli* colicins (e.g. ColE9 and ColE7), EndA from *S. pneumoniae*, NucA from *Anabaena* and CAD (Midon, Schafer et al. 2011). As well as having the HNH motif, several of these nucleases contain the signature DRGH motif and share structural homology with core elements forming the ββα-Me-finger active site motif. Mutational studies of residues in the HNH/DRGH motifs have confirmed their role in nucleic acid cleavage activity (Ku, Liu et al. 2002; Doudeva, Huang et al. 2006; Eastberg, Eklund et al. 2007; Huang and Yuan 2007). Furthermore, the DNA binding affinity and sequence preference for ColE7 could be effectively altered (Wang, Wright et al. 2009). Such detailed studies illustrate the potential in re-engineering nonspecific nucleases for targeted purposes.

Zinc-finger nucleases (ZFNs), generated by fusing Zinc-finger-based DNA-binding domains to an independent catalytic domain via a flexible linker (Kim, Cha et al. 1996; Smith, Berg et al. 1999; Smith, Bibikova et al. 2000), represent another type of engineered nuclease commonly used to stimulate gene targeting. The archetypal ZFNs are based on the catalytic domain of the Type IIS restriction enzyme FokI and have been successfully used to induce gene correction, gene insertion, and gene deletion. Zinc Finger-based DNA binding domains are made of strings of 3 or 4 individual Zinc Fingers, each recognizing a DNA triplet (Pabo, Peisach et al. 2001). In theory, one of the major advantages of ZFNs is that they are easy to design, using combinatorial assembly of preexisting Zinc Fingers with known recognition patterns (Choo and Klug 1994; Choo and Klug 1994; Kim, Lee et al. 2009). However, close examination of high resolution structures shows that there are actually cross-talks between units (Elrod-Erickson, Rould et al. 1996), and several methods have been used to assemble ZF proteins by choosing individual Zinc Fingers in a context dependant manner (Greisman and Pabo 1997; Isalan and Choo 2001; Maeder, Thibodeau-Beganny et al. 2008; Ramirez, Foley et al. 2008) to achieve better success rates and reagents of better quality.

Recently, a new class of chimeric nuclease using a FokI catalytic domain has been described (Christian, Cermak et al. 2010; Li, Huang et al. 2011). The DNA binding domain of these nucleases is derived from Transcription Activator Like Effectors (TALE), a family of proteins used in the infection process by plant pathogens of the *Xanthomonas* genus. In these DNA binding domains, sequence specificity is driven by a series of 33-35 amino acids repeats, differing essentially by two positions (Boch, Scholze et al. 2009; Moscou and Bogdanove 2009). Each base pair in the DNA target is contacted by a single repeat, with the specificity resulting from the two variant amino acids of the repeat (the so-called repeat variable dipeptide, RVD). The apparent modularity of these DNA binding domains has been confirmed to a certain extent by modular assembly of designed TALE-derived protein with new specificities (Boch, Scholze et al. 2009; Moscou and Bogdanove 2009). However, one cannot yet rule out a certain level of context dependence of individual repeat/base recognition patterns, as was observed for Zinc Finger proteins (see above). Furthermore, it has been shown that natural TAL effectors can dimerize (Gurlebeck, Szurek et al. 2005) and how this would affect a "dimerization-based" TALE-derived nuclease is currently unknown.

The functional layout of a FokI-based TALE-nuclease (TALEN) is essentially that of a ZFN, with the Zinc-finger DNA binding domain being replaced by the TALE domain (Christian, Cermak et al. 2010; Li, Huang et al. 2011). As such, DNA cleavage by a TALEN requires two DNA recognition regions flanking an unspecific central region. This central "spacer" DNA region is essential to promote catalysis by the dimerizing FokI catalytic domain, and extensive effort has been placed into optimizing the distance between the DNA binding sites (Christian, Cermak et al. 2010; Miller, Tan et al. 2011). The length of the spacer has been varied from 14 to 30 base pairs, with efficiency in DNA cleavage being interdependent with spacer length as well as TALE scaffold construction (i.e. the nature of the fusion construct used). It is still unknown whether differences in the repeat region (i.e. RVD type and number used) have an impact on the DNA "spacer" requirements or on the efficiency of DNA cleavage by TALENs. Nevertheless, TALE-nucleases have been shown to be active to various extents in cell-based assays in yeast, mammalian cells and plants (Christian, Cermak et al. 2010; Li, Huang et al. 2011; Mahfouz, Li et al. 2011; Miller, Tan et al. 2011).

The inventors have developed a new type of TALEN that can be engineered to specifically recognize and process target DNA efficiently. These novel "compact TALENs" (cTALENs) do not require dimerization for DNA processing activity, thereby alleviating the need for "dual" target sites with intervening DNA "spacers". Furthermore, the invention allows for generating several distinct types of enzymes that can enhance separate DNA repair pathways (HR vs. NHEJ).

BRIEF SUMMARY OF THE INVENTION

The present invention relates to a method to generate compact Transcription Activator-Like Effector Nucleases (TALENs) composed of a single polypeptide chain that do not require dimerization to target a specific single double-stranded DNA target sequence of interest and process DNA nearby said single double-stranded DNA target sequence of interest. The present invention also concerns the creation of functional single polypeptide fusion proteins for simple and efficient vectorization. In another aspect, the present invention relates to compact TALENs comprising at least an enhancer domain wherein said enhancer domain enhances the DNA processing efficiency of said compact TALENS nearby a single double-stranded DNA target sequence of interest. The present invention also relates to compact TALENS, vectors, compositions and kits used to implement the method. The present invention also relates to methods for use of said compact TALENs according to the invention for various applications ranging from targeted DNA cleavage to targeted gene regulation. The methods according to the present invention can be used in various fields ranging from the creation of transgenic organisms to treatment of genetic diseases.

BRIEF DESCRIPTION OF THE FIGURES

In addition to the preceding features, the invention further comprises other features which will emerge from the description which follows, as well as to the appended drawings. A more complete appreciation of the invention and many of the attendant advantages thereof will be readily obtained as the same becomes better understood by reference to the following Figures in conjunction with the detailed description below.

FIG. 2: Sequences of target DNA recognized by I-CreI and I-TevI. C1234 (SEQ ID NO: 3) represents the partially symmetric natural DNA sequence recognized and cleaved by the wild-type I-CreI meganuclease. C1221 (SEQ ID NO: 2) represents an artificial palindromic DNA sequence, derived from C1234 (SEQ ID NO: 3), also recognized and cleaved by I-CreI (SEQ ID NO: 1). Nucleotides are numbered outward (−/+) from the center of the target. DNA cleavage occurs on either side of the underlined sequence to generate 4-nucleotide 3' overhanging ends. For I-CreI-based meganucleases, the nature of the nucleotides at positions −2 to +2 can potentially interfere with the cleavage activity of the protein. Tev (SEQ ID NO: 105) represents the asymmetric DNA sequence recognized and cleaved by the wild-type I-TevI meganuclease. Nucleotide numbering is relative to the intron-insertion site of the natural target sequence. Cleavage by I-TevI occurs on either side of the underlined sequence to generate 2-nucleotide 3' overhanging ends.

FIG. 3: Sequences of the target DNAs recognized by TALEN and compact TALEN constructs. Target DNAs for the engineered compact TALENS cTN-Avr (amino acids 1-19 of SEQ ID NO:158) and cTN-Pth (SEQ ID NO:470) are based on the naturally occurring asymmetric sequences AvrBs3 (19 bp) [in bT1-Avr (SEQ ID NO: 136) and bT2-Avr (SEQ ID NO: 137) baseline protein scaffolds] and PthXo1 (25 bp) [in bT1-Pth (SEQ ID NO: 138) and bT2-Pth (SEQ ID NO: 139) baseline protein scaffolds], respectively. For each sequence, nucleotides are numbered outward (−/+) from the anchoring T (position −1). Sequences shown are directly contacted by the protein to provide target specificity. Wild-type Repeat Variable Dipeptides (RVDs) correspond to the dipeptides found in the repeats of the naturally occurring effector proteins targeted to each sequence. Cipher RVDs are based on the subset of dipeptide/nucleotide pairs listed. Artificial RVDs are derived by direct readout of the underlying DNA sequence using the cipher RVD code (SEQ ID NO: 245 to 249).

FIG. 4A-D: Schematic of meganuclease fusion configurations. Fusion constructs are optimized to address or overcome distinct problems. (FIG. 4A) The addition of two catalytic domains to an active meganuclease can not only enhance cleavage activity (e.g. three chances to effect DNA cleavage per binding event) but can also promote sequence alterations by error-prone NHEJ since small sections of DNA are excised for each pair of cleavage events. (FIG. 4B) When specificity reengineering precludes maintaining cleavage activity of the meganuclease, the attached catalytic domains provide the necessary strand cleavage function. (FIG. 4C) and (FIG. 4D) represent instances of (FIG. 4A) and (FIG. 4B), respectively, when only one catalytic domain is tolerated per fusion protein (e.g. either as an N- or C-terminal fusion or in the context of a single-chain molecule). In all cases, the catalytic domain envisioned can be either a cleavase (ability to cleave both strands of the DNA) or a nickase (cleavage of only a single DNA strand) depending on the application. Fusion junctions (N- vs. C-terminal) and linker designs can vary with the application. Components of the fusion proteins are listed in the legend.

FIG. 5A-C: Schematic of cTALEN configurations. Compact TALENs are designed to alleviate the need for multiple independent protein moieties when targeting a DNA cleavage event. Importantly, the requisite "spacer" region and dual target sites essential for the function of current classical TALENs are unnecessary. In addition, since the catalytic domain does not require specific DNA contacts, there are no restrictions on regions surrounding the core TALE DNA binding domain. (FIG. 5A) N-terminal fusion construct to promote HR via a standard (cleavase domain) or conservative (nickase domain) repair pathway. (FIG. 5B) C-terminal fusion construct with properties as in (FIG. 5A). (FIG. 5C) The attachment of two catalytic domains to both ends of the TALE allows for dual cleavage with enhancement in NHEJ. Fusion junctions (N- vs. C-terminal) and linker designs can vary with the application. Components of the fusion proteins are listed in the legend.

FIG. 6A-E: Schematic of enhanced cTALEN configurations. Compact TALENs can be enhanced through the addition of a domain to promote existing or alternate activities. As each end of the TALE DNA binding domain is amenable to fusion, the order (N- vs. C-terminal) of addition of the catalytic and enhancer domains can vary with the application. (FIG. 6A) A standard cTALEN with a C-terminal enhancer domain. (FIG. 6B) The enhancer domain is fused to the cTALEN via the N-terminus of the catalytic domain. Such a configuration can be used to assist and/or anchor the catalytic domain near the DNA to increase cleavage activity. (FIG. 6C) The enhancer domain is sandwiched between the catalytic domain and TALE DNA binding domain. The enhancer domain can promote communication between the flanking domains (i.e. to assist in catalysis and/or DNA binding) or can be used to overcome the requisite T nucleotide at position −1 of all TALE-based targets. (FIG. 6D) The enhancer domain is used to functionally replace the natural TALE protein N-terminal region. (FIG. 6E) The enhancer domain is used to functionally replace the natural TALE protein C-terminal region. Fusion junctions (N- vs. C-terminal) and linker designs can vary with the application. Components of the fusion proteins are listed in the legend.

FIG. 7A-C: Schematic of trans cTALEN configurations. Compact TALENs can be combined with auxiliary enhancer domains to promote alternate activities. Auxiliary domains provide an additional function that is not essential to the cTALEN activity. (FIG. 7A) A standard cTALEN with an N-terminal nickase catalytic domain becomes a "cleavase" via the separate addition of the auxiliary domain. (FIG. 7B) In some instances, the need to target the specificity of the auxiliary domain is necessary. Such a configuration can achieved via a TALE fusion and can be used to assist and/or anchor the auxiliary domain near the DNA to increase activity of the cTALEN. (FIG. 7C) The targeted auxiliary domain is provided either before or after the cTALEN to perform an independent task. Communication between the fusion proteins is not necessary. Fusion junctions (N- vs. C-terminal) and linker designs can vary with the application. Components of the fusion proteins are listed in the legend.

FIG. 8B-E: Consequences of cleavage of additional phosphodiester bonds. The addition of a single nickase activity (FIG. 8B) or of two nickase activities affecting the same strand (FIG. 8C) would result in a single strand gap, and suppress the cohesive ends, which could in turn affect the spectrum of events. Addition of two nickase activities affecting opposite strands (FIG. 8D) or of a new cleavase activity generating a second DSB (FIG. 8E) would result in a double strand gap; as a consequence, perfect re-ligation is no longer possible, and one or several alternative repair outcomes could be stimulated. The current figure makes no assumption regarding the relative frequencies of these alternative outcomes (imprecise NHEJ, homologous recombination, others . . . ). Solid triangles represent hydrolysis of phosphodiester bonds.

FIG. 9: Activity of TALE-AvrBs3::TevI in yeast (37° C.). The negative control consists in a TALEN without any RVDs. n.d. indicates no detectable activity, + indicates an activity over 0.3 in yeast assay and +++ indicates an activity over 0.7 in yeast assay (International PCT Applications WO 2004/067736 and in Epinat, Arnould et al. 2003; Chames, Epinat et al. 2005; Arnould, Chames et al. 2006; Smith, Grizot et al. 2006).

FIG. 11: Activity of TALE-AvrBs3::NucA in yeast (37° C.). The negative control is a target lacking a recognition site (neg. ctrl.: SEQ ID NO: 228). Compact is a target having only one recognition site (SEQ ID NO: 224). n.d. indicates no detectable activity, + indicates an activity over 0.3 in yeast assay at 37° C.; ++, activity over 0.5 in yeast assay at 37° C. and +++ activity over 0.7 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 12: Activity of TALE-AvrBs3::ColE7 in yeast (37° C.). The negative control is a target lacking a recognition site (neg. ctrl.: SEQ ID NO: 228). Compact is a target having only one recognition site (SEQ ID NO: 224). n.d. indicates no detectable activity, + indicates an activity over 0.3 in yeast assay at 37° C.; ++, activity over 0.5 in yeast assay at 37° C. and +++ activity over 0.7 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 13: Schematic and details of a TALE::CreI prototypical compact TALEN. This class of compact TALEN targets a bipartite recognition sequence comprised of the TALE DNA binding site proximal to a meganuclease target site. The engineered TCRB02-A meganuclease site is shown along with details of the RVDs and DNA sequences recognized by the TALE moiety. A region of the T cell receptor B gene is presented, highlighting the endogenous layout of the TALE::CreI-based compact TALEN hybrid target site.

FIG. 14: Activity of TALE::scTB2aD01-based constructs in yeast (30° C.). The layouts of the various hybrid targets are shown, starting (5') with the region recognized by the TALE DNA binding domain in uppercase, the unspecific spacer region in lowercase and the meganuclease target site in underlined uppercase characters. Activity in yeast is illustrated for select representative constructs. n.d. indicates no detectable activity, + indicates an activity over 0.3 in yeast assay at 30° C.; ++, activity over 0.5 in yeast assay at 30° C. and +++ activity over 0.7 in yeast assay at 30° C. (International PCT Applications WO 2004/067736 and in Epinat, Arnould et al. 2003; Chames, Epinat et al. 2005; Arnould, Chames et al. 2006; Smith, Grizot et al. 2006).

FIG. 18: Activity of TevI::TALE-AvrBs3+/−TALE-RagT2-R::TevI in yeast (37° C.). The negative control is a target lacking a recognition site (neg. ctrl.: SEQ ID NO: 228). n.d. indicates no detectable activity, + indicates an activity over 0.3 in yeast assay at 37° C.; ++, activity over 0.5 in yeast assay at 37° C. and +++ activity over 0.7 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 19: Activity of TALE::SnaseSTAAU in yeast (37° C.). The negative control is a target lacking recognition sites. Compact is a target having only one recognition site (SEQ ID NO: 224). n.d. indicates no detectable activity at 37° C., +/− indicated an activity above 0.3 in yeast assay at 37° C.; + indicated an activity over 0.3 in yeast assay at 37° C.; ++ indicated an activity over 0.5 in yeast assay at 37° C.; +++ indicated an activity over 0.75 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 20: Activity of TALE::ColE7 with various polypeptide linker in yeast (37° C.). Compact is a target having only one recognition site (SEQ ID NO: 224). n.d. indicates no detectable activity at 37° C., + indicated an activity over 0.3 in yeast assay at 37° C.; ++ indicated an activity over 0.5 in yeast assay at 37° C.; +++ indicated an activity over 0.75 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 21: List of AvrBs3 targets with various spacer lengths (SEQ ID NO: 157 to 192).

FIG. 22: List of AvrBs3 targets with various spacer lengths (SEQ ID NO: 157 to 192) including a target with only one recognition site (compact, SEQ ID NO: 224) and a negative control target (neg. ctrl., SEQ ID NO: 228) consisting in a target without any recognition site.

FIG. 23: List of hybrid RagT2=R/AvrBs3 targets with various spacer lengths (SEQ ID NO: 315 to 350).

DETAILED DESCRIPTION OF THE INVENTION

Figure 1:
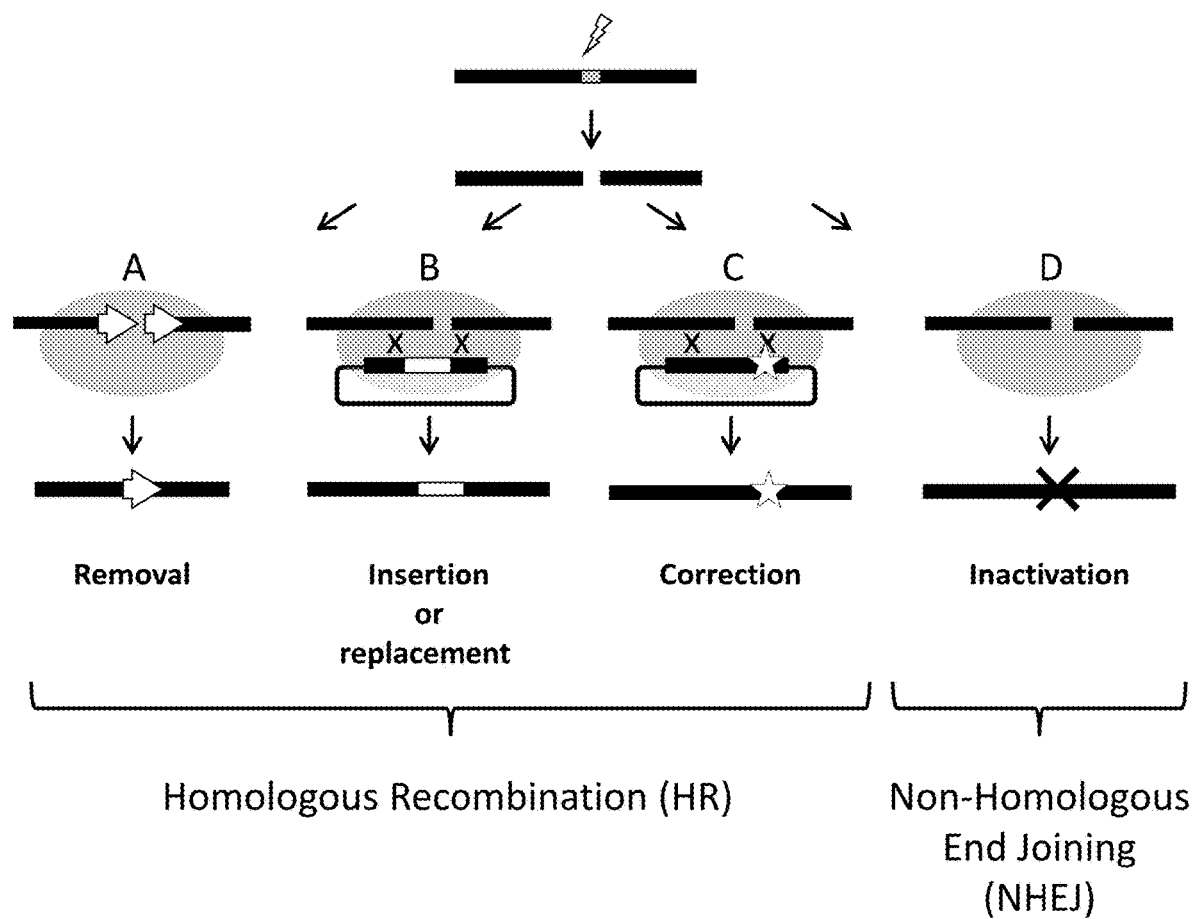
FIG. 1: Endonuclease-induced gene targeting approaches. Upon cleavage, DNA repair mechanisms may result in one of several outcomes. (A) When a double-strand break is targeted between two direct repeats, HR can result in the deletion of one repeat together with the intervening sequence. Gene insertion (B) or correction (C) can be achieved by the introduction of a DNA repair matrix containing sequences homologous to the endogenous sequence surrounding the DNA break. Mutations can be corrected either at or distal to the break, with the frequency of correction decreasing with increasing distance. (D) The misrepair of DNA ends by error-prone NHEJ can result in insertions or deletions of various sizes, leading to gene inactivation.

Unless specifically defined herein, all technical and scientific terms used have the same meaning as commonly understood by a skilled artisan in the fields of gene therapy, biochemistry, genetics, and molecular biology.

All methods and materials similar or equivalent to those described herein can be used in the practice or testing of the present invention, with suitable methods and materials being described herein. All publications, patent applications, patents, and other references mentioned herein are incorporated by reference in their entirety. In case of conflict, the present specification, including definitions, will prevail. Further, the materials, methods, and examples are illustrative only and are not intended to be limiting, unless otherwise specified.

The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Current Protocols in Molecular Biology (Frederick M. AUSUBEL, 2000, Wiley and son Inc, Library of Congress, USA); Molecular Cloning: A Laboratory Manual, Third Edition, (Sambrook et al, 2001, Cold Spring Harbor, N.Y.: Cold Spring Harbor Laboratory Press); Oligonucleotide Synthesis (M. J. Gait ed., 1984); Mullis et al. U.S. Pat. No. 4,683,195; Nucleic Acid Hybridization (B. D. Harries & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the series, Methods In ENZYMOLOGY (J. Abelson and M. Simon, eds.-in-chief, Academic Press, Inc., New York), specifically, Vols. 154 and 155 (Wu et al. eds.) and Vol. 185, "Gene Expression Technology" (D. Goeddel, ed.); Gene Transfer Vectors For Mammalian Cells (J. H. Miller and M. P. Calos eds., 1987, Cold Spring Harbor Laboratory); Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); and Manipulating the Mouse Embryo, (Cold Spring Harbor Laboratory Press, Cold Spring Harbor, N.Y., 1986).

In a first aspect, the present invention relates to a method to generate compact Transcription Activator-Like Effector Nucleases (cTALENs) composed of a single polypeptide chain that do not require dimerization to target a specific single double-stranded DNA target sequence of interest and process DNA nearby said single double-stranded DNA target sequence of interest.

According to a first aspect of the present invention is a method to generate compact Transcription Activator-Like Effector Nucleases (cTALENs) comprising the steps of:
  (i) Engineering a core TALE scaffold (a) comprising different sets of Repeat Variable Dipeptide regions (RVDs) to change DNA binding specificity and target a specific single double-stranded DNA target sequence of interest, (b) onto which a selection of catalytic domains can be attached to effect DNA processing;
  (ii) Determining or engineering at least one catalytic domain wherein said catalytic domain is capable of processing DNA nearby said single double-stranded DNA target sequence of interest when fused to said engineered core TALE scaffold from (i);
  (iii) Optionally determining or engineering a peptidic linker to fuse said catalytic domain from (ii) to said engineered core TALE scaffold from (i);
  thereby obtaining a compact TALEN entity composed of a single polypeptide chain that does not require dimerization to target a specific single double-stranded DNA target sequence of interest and process DNA nearby said single double-stranded DNA target sequence of interest. In other words, the compact TALEN according to the present invention is an active entity unit able, by itself, to target only one specific single double-stranded DNA target sequence of interest through one DNA binding domain and to process DNA nearby said single double-stranded DNA target sequence of interest.

In another embodiment, is a method for targeting and processing a double-stranded DNA, comprising:
  (a) Selecting one DNA target sequence of interest on one strand of a double-stranded DNA;
  (b) Providing a unique compact TALEN monomer comprising:
    (i) One core TALE scaffold comprising Repeat Variable Dipeptide regions (RVDs) having DNA binding specificity onto said DNA target sequence of interest;
    (ii) At least one catalytic domain wherein said catalytic domain is capable of processing DNA a few base pairs away from said DNA target sequence of interest when fused to the C and/or N terminal of said core TALE scaffold from (i);

(iii) Optionally one peptidic linker to fuse said catalytic domain from (ii) to said core TALE scaffold from (i) when needed;
wherein said compact TALEN monomer is assembled to bind and process said double stranded DNA without requiring dimerization;
(c) Contacting said double-stranded DNA with said unique monomer such that the double-stranded is processed a few base pairs away in 3' and/or 5' direction(s) from said one strand target sequence.

In another embodiment, said engineered core TALE scaffold according to the present invention comprises an additional N-terminal domain resulting in an engineered core TALE scaffold sequentially comprising a N-terminal domain and different sets of Repeat Variable Dipeptide regions (RVDs) to change DNA binding specificity and target a specific single double-stranded DNA target sequence of interest, onto which a selection of catalytic domains can be attached to effect DNA processing.

In another embodiment, said engineered core TALE scaffold according to the present invention comprises an additional C-terminal domain resulting in an engineered core TALE scaffold sequentially comprising different sets of Repeat Variable Dipeptide regions (RVDs) to change DNA binding specificity and target a specific single double-stranded DNA target sequence of interest and a C-terminal domain, onto which a selection of catalytic domains can be attached to effect DNA processing.

In another embodiment, said engineered core TALE-scaffold according to the present invention comprises additional N-terminus and a C-terminal domains resulting in an engineered core TALE scaffold sequentially comprising a N-terminal domain, different sets of Repeat Variable Dipeptide regions (RVDs) to change DNA binding specificity and target a specific single double-stranded DNA target sequence of interest and a C-terminal domain, onto which a selection of catalytic domains can be attached to effect DNA processing. In another embodiment, said engineered core TALE-scaffold according to the present invention comprises the protein sequences selected from the group consisting of ST1 (SEQ ID NO: 134) and ST2 (SEQ ID NO: 135). In another embodiment, said engineered TALE-scaffold comprises a protein sequence having at least 80%, more preferably 90%, again more preferably 95% amino acid sequence identity with the protein sequences selected from the group consisting of SEQ ID NO: 134 and SEQ ID NO: 135.

In another embodiment, said engineered core TALE-scaffold according to the present invention comprises the protein sequences selected from the group consisting of bT1-Avr (SEQ ID NO: 136), bT2-Avr (SEQ ID NO: 137), bT1-Pth (SEQ ID NO: 138) and bT2-Pth (SEQ ID NO: 139). In another embodiment, said engineered TALE-scaffold comprises a protein sequence having at least 80%, more preferably 90%, again more preferably 95% amino acid sequence identity with the protein sequences selected from the group consisting of SEQ ID NO: 136 to SEQ ID NO: 139.

In a preferred embodiment according to the method of the present invention, said additional N-terminus and C-terminal domains of engineered core TALE scaffold are derived from natural TALE. In a more preferred embodiment said additional N-terminus and C-terminal domains of engineered core TALE scaffold are derived from natural TALE like AvrBs3, PthXo1, AvrHah1, PthA, Tal1c as non-limiting examples. In another more preferred embodiment, said additional N-terminus and/or said C-terminal domains are truncated forms of respective N-terminus and/or said C-terminal domains of natural TALE like AvrBs3, PthXo1, AvrHah1, PthA, Tal1c as non-limiting examples from which they are derived. In a more preferred embodiment, said additional N-terminus and C-terminal domains sequences of engineered core TALE scaffold are selected from the group consisting of ST1 SEQ ID NO: 134 and ST2 SEQ ID NO: 135 as respectively exemplified in baseline protein scaffolds bT1-Avr (SEQ ID NO: 136) or bT1-Pth (SEQ ID NO: 138) and bT2-Avr (SEQ ID NO: 137) or bT2-Pth (SEQ ID NO: 139).

In another embodiment, each RVD of said core scaffold is made of 30 to 42 amino acids, more preferably 33 or 34 wherein two critical amino acids located at positions 12 and 13 mediates the recognition of one nucleotide of said nucleic acid target sequence; equivalent two critical amino acids can be located at positions other than 12 and 13 specially in RVDs taller than 33 or 34 amino acids long. Preferably, RVDs associated with recognition of the different nucleotides are HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. More preferably, RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, RVDS associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 can be mutated towards other amino acid residues in order to modulate their specificity towards nucleotides A, T, C and G and in particular to enhance this specificity. By other amino acid residues is intended any of the twenty natural amino acid residues or unnatural amino acids derivatives.

In another embodiment, said core scaffold of the present invention comprises between 8 and 30 RVDs. More preferably, said core scaffold of the present invention comprises between 8 and 20 RVDs; again more preferably 15 RVDs.

In another embodiment, said core scaffold comprises an additional single truncated RVD made of 20 amino acids located at the C-terminus of said set of RVDs, i.e. an additional C-terminal half-RVD. In this case, said core scaffold of the present invention comprises between 8.5 and 30.5 RVDs, "0.5" referring to previously mentioned half-RVD (or terminal RVD, or half-repeat). More preferably, said core scaffold of the present invention comprises between 8.5 and 20.5 RVDs, again more preferably, 15.5 RVDs. In a preferred embodiment, said half-RVD is in a core scaffold context which allows a lack of specificity of said half-RVD toward nucleotides A, C, G, T. In a more preferred embodiment, said half-RVD is absent.

In another embodiment, said core scaffold of the present invention comprises RVDs of different origins. In a preferred embodiment, said core scaffold comprises RVDs originating from different naturally occurring TAL effectors. In another preferred embodiment, internal structure of some RVDs of the core scaffold of the present invention are constituted by structures or sequences originated from different naturally occurring TAL effectors. In another embodiment, said core scaffold of the present invention comprises RVDs-like domains. RVDs-like domains have a sequence different from naturally occurring RVDs but have the same function and/or global structure within said core scaffold of the present invention.

In another embodiment, said additional N-terminal domain of said engineered core TALE scaffold is an enhancer domain. In another embodiment, said enhancer domain is selected from the group consisting of Puf RNA binding protein or Ankyrin super-family, as non-limiting examples. In another embodiment, said enhancer domain sequence is selected from the group consisting of protein domains of SEQ ID NO: 4 and SEQ ID NO: 5, as non-limiting examples listed in Table 1, a functional mutant, a variant or a derivative thereof.

In another embodiment, said additional C-terminal domain of said engineered core TALE scaffold is an enhancer domain. In another embodiment, said enhancer domain is selected from the group consisting of hydrolase/transferase of *Pseudomonas* Aeuriginosa family, the polymerase domain from the *Mycobacterium tuberculosis* Ligase D family, the initiation factor eIF2 from *Pyrococcus* family, the translation initiation factor Aif2 family, as non-limiting examples. In another embodiment, said enhancer domain sequence is selected from the group consisting of protein domains of SEQ ID NO: 6 to SEQ ID NO: 9, as non-limiting examples listed in Table 1, a functional mutant, a variant or a derivative thereof.

| GENBANK/SWISS-PORT ID | NAME | SEQ ID NO | FASTA SEQUENCE |
|---|---|---|---|
| gi\|262368139\|pdb\|3K5Q\| | fem-3 | 4 | >gi\|262368139\|pdb\|3K5Q\|A Chain A, Crystal Structure Of Fbf-2FBE COMPLEX SNNVLPTWSLDSNGEMRSTLSLSEVLDSGDLMKFAVDKTGCQFLEKAVKGSLTSYQKFQLFEQVIGRKDD FLKLSTNIFGNYLVQSVIGISLATNDDGYTKRQEKLKNFISSQMTDMCLDKFACRVIQSSLQNMDLSLAC KLVQALPRDDARLIAICVDQNANHVIQKVVAVIPLKNWEFIVDFVATPEHLRQICSDKVGCRVVQTIIEKL TADSMNVDLTSAAQNLRERALQRLMTSVTNRCQELATNEYANYIIQHIVSNDDLAVYRECIIEKCLMRNL LSLSQEKFASHVVEKAFLHAPLELLAEMMDEIFDGYIPHPOTGKDALDIMMFHQFGNYVVQCMLTICCDA VSGRRQTKEGGYDHAISFQDWLKKLHSRVTKERHRLSRFSSKKMIETLANLRSTHPIYELQ |
| gi\|308387836\|pdb\|3LTI\| | aRep | 5 | >gi\|308387836\|pdb\|3LTI\|a Chain A, Structure Of A New Family Of Artificial Alpha Hellcoidal Repeat Proteins (alpha-Rep) Based On Thermostable Heat-Like Repeats MRGSHHHHHHTDPEKVEMYIKNLQDDSYYVRAAAVALGKIGDERAVEPLIKALKDEDAWVRRAAADALGQIGD ERAVEPLIKALKDEDGWVRQSAAVALGQIGDERAVEPLIKALKDEDWFVRIAAAFALGEIGDERAVEPLIKALKDED GWVRQSAADALGEIGGERVRAAMEKLAEFTGTGFARKVAVNYLETHKSLIS |
| gi\|109157579\|pdb\|2FAO\| | Pseudomonas Aeruginosa Ligd Polymerase Domain | 6 | >gi\|109157579\|pdb\|2FAO\|A Chain A, Crystal Structure Of Pseudomonas Aeruginosa Ligd Polymerase Domain MGARKASAGASRAATAGVRISHPQRLIDPSIQASKLELAFFHARYADLLRDLRERPVSLVRGPDGIGGE LFFQKHAARLKIPGIVQLDPALDPGHPPLLQIRSAEALVGAVQMGSIEFHTWNASLANLERPDRFVLDLD PDPALPWKRMLEATQLSLITLLDELGLRAFLKTSGGKGMHLLVPLERRHGWDEVKDFAQAISQHLARLMPE RFSAVSGPRNRVGKIFVDYLRNSRGASTVAAYSVRAREGLPVSVPVFREELDSLQGANQWNLRSLPQRLD ELAGDDPWADYAGTRQRISAAMRRQLGRG |
| 2R9L_A GI: 164519498 | Mycobacterium Tuberculosis Ligase D | 7 | Polymerase Domain From Mycobacterium Tuberculosis Ligase D in Complex With Dna; Accession: 2R9L_A GI: 164519498 >gi\|164519498\|pdb\|2R9L\|A Chain A, Polymerase Domain From Mycobacterium Tuberculosis Ligase D in Complex With Dna GSHMGSASEQRVTLTNADKVLYPATGTTKSDIFDYYAGVAEVMLGHIAGRPATRKRWPNGVDQPAFFEKQ LALSAPPWLSRATVAHRSGTTTYPIIDSATGLAWIAQQAALEVHVPQWRFVAEPGSGELNPGPATRLVFD LDPGEGVMMAQLAEVARAVRDLLADIGLVTFPVTSGSKGLHLYTOKDEOVSSRGATVLAKRVAQRLEQAM PALVTSMTSLRAGKVFDWSQNSGSKTTIAPYSLRGRTHPTVAAPRTWAELDDPALRQLSVDEVLTRI ARDGDLLERLDADAPVADRLTRY |

-continued

| GENBANK/SWISS-PORT ID | NAME | SEQ ID NO | FASTA SEQUENCE |
|---|---|---|---|
| 1KJZ_A GI: 20664108 | Large Gamma Subunit Of Initiation Factor Eif2 From Pyrococcus Abyssi | 8 | Structure Of The Large Gamma Subunit Of Initiation Factor Eif2 From *Pyrococcus Abyssi*-G235d Mutant: 1KJZ_A GI: 20664108, >Gi\|20664108\|pdb\|1KJ2\|A Chain A, Structure Of The Large Gamma Subunit Of Initiation Factor Eif2 From Pyrococcus Abyssi-G235d Mutant GEKRKSRQAEVNIGMVGHVDHGKTTLTKALTGVWTDTHSEELRRGITIKIGFADAEIRRCPNCGRYSTSP VCPYCGHETEFVRRVSFIDAPGHEALMTTMLAGASLMDGAILVIAANEPCRPQTREHLMALQIIGQKNI IIAQNKIELVDKEKALENYRQIKEFIEGTVAENAPIIPISALHGANIDVLVKAIEDFIPTPKRDPNKPPK MLVLRSFDVNKPGTPPEKLVGGVLDGSIVQGKLKVGDEIEIRPGVPYEEHGTIKYEPITTEIVSLQAGGQ FVEEAYPGGLVGVGTKLDPYLKGDLMAGNVVGKPGKLPPPVWDSLRLEVHLLERVVGTEQELKVEPIKRK EVLLLNVGTARTMGLVTGLGKDEIEVKLQIPVCAEPGDRVAISRQIGSRWRLIGYGIIKE |
| 2D74_A GI: 112490420 | Translation Initiation Factor Aif2betagamma | 9 | Crystal Structure Of Translation initiation Factor Aif2betagamma Heterodimer: 2D74_A GI: 112490420, >gi\|112490420\|pdb\|2D74\|A Chain A, Crystal Structure Of Translation Initiation Factor Aif2betagamma Heterodimer MGEKRKTRAQAEVNIGMVGHVDHGKTTLTKALTGVWTDTHSEELRRGITIKIGFADAEIRRCSNCGRYSTS PICPYCGHETEFIRRVSFIDSPGHEALMTTMLAGASLMDGAILVIAANEPCRPQTREHLMALQIIGQKN IIIAQNKIELVDKEKALENYRQIKEFIKGTVAENAPIIPISALHGANIDVLVKAIEEFIPTPKRDSNKPP KMLVLRSFDVNKPGTPPEKLVGGVLDGSIVQGKLKVGDEIEIRPPGVPYEEHGRIKYEPITTIVSLQAGG QFVEEAYPGGLVGIGTKLDPYLKGDLMAGNVVGKPGKLPPVWTDRKEVHLLERVVGTEQELNVEPIKR KEVLLLNVGTARTMGLVTALGKDEIELKLQIPVCAEPGERVAISQQISGRWRLIGYGILLKELEHHHHHH |

Table 1: List of Enhancer Domains for Engineered Core TALE Scaffold.

In another preferred embodiment according to the method of the present invention, the catalytic domain that is capable of processing DNA nearby the single double-stranded DNA target sequence of interest, when fused to said engineered core TALE scaffold according to the method of the present invention, is fused to the N-terminus part of said core TALE scaffold. In another preferred embodiment, said catalytic domain is fused to the C-terminus part of said core TALE scaffold. In another preferred embodiment two catalytic domains are fused to both N-terminus part of said core TALE scaffold and C-terminus part of said core TALE scaffold. In a more preferred embodiment, said catalytic domain has an enzymatic activity selected from the group consisting of nuclease activity, polymerase activity, kinase activity, phosphatase activity, methylase activity, topoisomerase activity, integrase activity, transposase activity or ligase activity. In another preferred embodiment, the catalytic domain fused to the core TALE scaffold of the present invention can be a transcription activator or repressor (i.e. a transcription regulator), or a protein that interacts with or modifies other proteins such as histones. Non-limiting examples of DNA processing activities of said compact TALEN of the present invention include, for example, creating or modifying epigenetic regulatory elements, making site-specific insertions, deletions, or repairs in DNA, controlling gene expression, and modifying chromatin structure.

In another more preferred embodiment, said catalytic domain has an endonuclease activity. In another more preferred embodiment, said catalytic domain has cleavage activity on said double-stranded DNA according to the method of the present invention. In another more preferred embodiment, said catalytic domain has a nickase activity on said double-stranded DNA according to the method of the present invention. In another more preferred embodiment, said catalytic domain is selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), E. coli ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative thereof. In another preferred embodiment according to the method of the present invention, said catalytic domain is I-TevI (SEQ ID NO: 20), a functional mutant, a variant or a derivative thereof. In another preferred embodiment, catalytic domain I-TevI (SEQ ID NO: 20), a functional mutant, a variant or a derivative thereof is fused to the N-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 420-432.

In another preferred embodiment, said catalytic domain is ColE7 (SEQ ID NO: 11), a functional mutant, a variant or a derivative thereof. In another preferred embodiment, catalytic domain ColE7 (SEQ ID NO: 11), a functional mutant, a variant or a derivative thereof is fused to the N-terminal domain of said core TALE scaffold according to the method of the present invention. In another preferred embodiment, catalytic domain ColE7 (SEQ ID NO: 11), a functional mutant, a variant or a derivative thereof is fused to the C-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 435-438.

In another preferred embodiment, said catalytic domain is NucA (SEQ ID NO: 26), a functional mutant, a variant or a derivative thereof. In another preferred embodiment, catalytic domain NucA (SEQ ID NO: 26), a functional mutant, a variant or a derivative thereof is fused to the N-terminal domain of said core TALE scaffold according to the method of the present invention. In another preferred embodiment, catalytic domain NucA (SEQ ID NO: 26), a functional mutant, a variant or a derivative thereof is fused to the C-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 433-434.

In another preferred embodiment, said catalytic domain is I-CreI (SEQ ID NO: 1), a functional mutant, a variant or a derivative thereof. In another preferred embodiment, catalytic domain I-CreI (SEQ ID NO: 1), a functional mutant, a variant or a derivative thereof is fused to the N-terminal domain of said core TALE scaffold according to the method of the present invention. In another preferred embodiment, catalytic domain I-CreI (SEQ ID NO: 1), a functional mutant, a variant or a derivative thereof is fused to the C-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 439-441 and SEQ ID NO: 444-446.

In another embodiment, said catalytic domain is a restriction enzyme such as MmeI, R-HinPII, R.MspI, R.MvaI, Nb.BsrDI, BsrDI A, Nt.BspD6I, ss.BspD6I, R.PleI, MlyI and AlwI as non-limiting examples listed in table 2. In another more preferred embodiment, said catalytic domain has an exonuclease activity.

In another more preferred embodiment, any combinations of two catalytic domains selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_

SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E. coli* ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative of these protein domains thereof, can be fused to both N-terminus part and C-terminus part of said core TALE scaffold, respectively. For example, I-HmuI catalytic domain can be fused to the N-terminus part of said core TALE scaffold and ColE7 catalytic domain can be fused to the C-terminus part of said core TALE scaffold. In another example, I-TevI catalytic domain can be fused to the N-terminus part of said core TALE scaffold and ColE7 catalytic domain can be fused to the C-terminus part of said core TALE scaffold.

In another embodiment, according to the method of the present invention, said unique compact TALEN monomer comprises a combination of two catalytic domains respectively fused to the C-terminus part and to the N-terminus part of said core TALE scaffold selected from the group consisting of:
  (i) A Nuc A domain (SEQ ID NO: 26) in N-terminus and a Nuc A domain (SEQ ID NO: 26) in C-terminus;
  (ii) A ColE7 domain (SEQ ID NO: 11) in N-terminus and a ColE7 domain (SEQ ID NO: 11) in C-terminus;
  (iii) A TevI domain (SEQ ID NO: 20) in N-terminus and a ColE7 domain (SEQ ID NO: 11) in C-terminus;
  (iv) A TevI domain (SEQ ID NO: 20) in N-terminus and a NucA domain (SEQ ID NO: 26) in C-terminus;
  (v) A ColE7 domain (SEQ ID NO: 11) in N-terminus and a NucA domain (SEQ ID NO: 26) in C-terminus;
  (vi) A NucA domain (SEQ ID NO: 26) in N-terminus and a ColE7 domain (SEQ ID NO: 11) in C-terminus.

In another preferred embodiment, said compact TALEN according to the method of the present invention comprises a protein sequence having at least 80%, more preferably 90%, again more preferably 95% amino acid sequence identity with the protein sequences selected from the group consisting of SEQ ID NO: 448 and 450.

In another preferred embodiment, said compact TALEN according to the method of the present invention comprises a combination of two catalytic domains respectively fused to the C-terminus part and to the N-terminus part of said core TALE scaffold selected from the group consisting of:
  (i) A TevI domain (SEQ ID NO: 20) in N-terminus and a FokI domain (SEQ ID NO: 368) in C-terminus;
  (ii) A TevI domain (SEQ ID NO: 20) in N-terminus and a TevI domain (SEQ ID NO: 20) in C-terminus;
  (iii) A scTrex2 domain (SEQ ID NO: 451) in N-terminus and a FokI domain (SEQ ID NO: 368) in C-terminus.

In another preferred embodiment, said compact TALEN according to the method of the present invention comprises a protein sequence having at least 80%, more preferably 90%, again more preferably 95% amino acid sequence identity with the protein sequences selected from the group consisting of SEQ ID NO: 447-450 and SEQ ID NO: 452.

In the scope of the present invention, it can be envisioned to insert said catalytic domain between two parts of the engineered core TALE scaffold according to the invention, each part comprising one set of RVDs. In this last case, the number of RVDs for each part of the engineered core TALE scaffold can be the same or not. In other words, it can be envisioned to split said core TALE scaffold of the present invention to insert one catalytic domain between the resulting two parts of said engineered core TALE scaffold. In another preferred embodiment, said compact TALEN according to the method of the present invention comprises a protein sequence having at least 80%, more preferably 90%, again more preferably 95% amino acid sequence identity with the protein sequences selected from the group consisting of SEQ ID NO: 453-455.

TABLE 2

List of catalytic/enhancer domains for compact TALENs or enhanced compact TALENs.

| GENBANK/SWISS-PROT ID | NAME | SEQ ID NO | FASTA SEQUENCE |
|---|---|---|---|
| ACC85607.1 | MineI | 10 | >gi|186469979|gb|ACC85607.1| WmsI [Methylophilus methylotrophus] MALSWNEIRRKAIEPSKRWEDASDENSQAKPFLIDFFEVFGITNKRVATFEHAVKKFAKAHKEQSRGFVD LFWGGILLIEMKSRGKDLDKAYDQALDYFSGIAERDLPYVGVCDFQRFRLTDLITKESVEFLLKOLYQN VRSFGFIAGYQTQVIKPQDPINIKAAERMGKLHDTLKLVGYEGHALELYIVRLLFCLEAKDTTIFSKSLF QEYIETKTLEDGSDLAHHLNTLFVVLNTPEQKRLKNLDEHLAAFPYINGKLFEEPLPPAQFDKAMREALL DLCSLDWSRISPAIFGSLFQSIMDAKKRRNLGAHYTSEANILKLIKRLFLDELWVEFEKVKNNKNKLLAF HKKLRGLLTFFDPACGGCNFLVITYRELRLLEISVLRGLHRGGQQVLDIEHLIQINVDQFFGIEIEEFPAQ IAQVALWLITDHQMNMKISDEFGNYFARIPIKSTPHILNANALQIDWNDVLEAKKCCPILGNPPFCGESKQ TPGQKADLLSVFGNLKSASDLDLVAAMYPKAAHYIQTNANIRCAFVSTNSITQGEQVISLLWPLLLSLGTK INFAHRTFSWTNEASGVAAVHCVIIGFGLKDSDKKIIYEYESINGEPLAIKAKNINPYLRDGVDVIACKR QQPISKLPSMRYGNKPTDDGNFLFTDEERNQFITNEPSSEKYFRRFVGGDEFINNTSRWVLWLDGADISE IRAMPLVLARIKKVQEFRLKSSAKPTRQSASTPMKFFYISQPDTDYLLIPETSSENRQFIPIGFVDRNVI SSNATYHIPSAEPLIFGLLSSTMHCWMPNVGGRLESRYRYSASLVTNTFPWIOPNEKQSKAIEEAAFAI LKARSNYPNESLAGLYDPKTMPSELLKAHQKLDKAVDSVVGFKGPNTEIARIAFLFETYQKMTSLLPPEK EIKKSKGKN |
| Q47112.2 | Coticin-E7 (CEA7_ECOLX) | 11 | >gi|12644448|sp|Q47112.2|CEA7_ECOLX RecName: Full = Colicin-E7 MSGGDGRGHNSGAHNTGGNINGGPTGLGGNGGASDGSGWSSENNPWGGGSGVHWGGSGHGNGGGNSN SGGGSNSSVAAPMAFGFPALAAPGAGTLGISVSGEALSAAIADIFAALKGPFKFSAWGIALYGILPSEIA EDDPNMMSKIVTHSLPAETVTNVQVSTLPLDQATVSVTKRVTDVVKDTRQHIAVVAGVPMSVPVVNAKPTR TPGVFHASFPGVPSLTVSTVKGLPVSTTLPRGITEDKGRTAVPAGFTFGGGSHEAVIRPPKESGQKPVTV SVTDVLTFAQVKQRQDEEKRLQQEMNDAPTFVEVAERNYEQARAELNQANKDVARNQERQAKAVQVYNSRK SELDAANKTLADAKAEIKQPERFAREPMAAGHPMWQMAGLKAQRAQTDVNNKKAAFDAAAKEKSDADVAL SSALERRKQKENKEKDAKAKLDMESKRNKPGKATGKGKPVNNKWLNNAGKKDLGSPVPDRIANKLRDKEFK SFDDFRKKFWEEVSKDPELSKQFSRNNNDRMKVGKAPKTRTQDVSGFRTSFELHHEKPISQNGGVYDMDN ISVVTPKRHIDIHRGK |
| CAA38134.1 | EndA | 12 | >GI|47374|EMB|CAA38134.1| EndA [Streptococcus pneumoniae] MNKKTRQTLIGLLVLLLLSTGSYYIKQMPSAPNSPKTNLSQKKQASEAPSQALAESVLITDAVKSQIKGSL EWNGSGAFIVNGNKTNLDAKVESKPYADNKTKTVGKETVPTVANALLSKATRQYKNRKETGNGSTSWTPP GWHQVKNLKGSYYTHAVDRGHLLGYALIGGLDGFDASTSNPKNIAVQTAWANQAEYSTGQNYYESKVRK ALDQNKPVRYRVTLYYASNEDLVPSASQIEAKSSDGELEFNVLVPNVQKGLQLDYHTGSVTVTQ |
| P25736.1 | Endo 1 (END1_ECOLI) | 13 | >gi|119325|sp|P25736.1|END1_ECOLI RecName: Full = Endonuclease I; AltName: Full = Endonuclear-1; short = Endo I, Flags: Precursor MYRYLSIAAVVLSAAFSGPALASGINSFSQQAKAAAVKVHADAPGTFYCGCKINWQGKKGVVDLQSCGYQV RKNENRASRVEWEHVVPAWQFGHQRQCWQDGGRJBVAJDPVYRKNCAKDPVYRKMESDMHNLQPSVGEVBGDRGBFNTSQ WNGGEGQYGCAMKEKKAAEPPARARGAIARTYFYMRDQYNLTLSRQOTQLFNAWNKMYPVTDWECE RDERIAKKVQGNHNPYVQRACQARKS |
| Q14249.4 | Human Endo G (NUCG_HUMAN) | 14 | >gi|317373579|sp|Q14249.4|NUCG_HUMAN RecName: Full = Endonuclease G, mitochondrial; Short = Endo G; Flags: Precursor, MRALRAGLTLASGAGLGAVVEGWRRREDARAAPGLLGLPLVAAAELPPVPGGPRGPGELAKYGLP GLAQLKSRESYVLCYDPPTRGALWVVSQLRPERLRGDGDRRECDFREDDSVHAYHRATNADYRGSGFDRG HLAAAANHKWSQKAMDDTFYLSNVAPQVPHLNQNAWNNLEKYSRSLTRSYQNVVVCTGPLFPRTEADGK |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| P38447.1 | Bovine Endo G (NUCG_BOVIN) | 15 | SYVKYQVIGKNHVAVPTHFFKVLILEAAGGQIELRTYVMPNAPVDEAIPLERFLVPIESIERASGLLFVP NILARAGSLKAITAGSK<br>>gi|585596|sp|P38447.1|NUCG_BOVIN RecName: Full = Endonuclease G, mitochondrial; Short = Endo G; Flags; Precursor<br>MQLLRAGLITALGAGLGAAAESWWRQRADARATPGLLSRLPVLPVAAAGLPAVPGAPAGGPGELAKYG LPGVAQLKSRASYVLCYDPRTRGALWVVEQLRPEGLRGDGNRSSCDFHEDDSVHAYHRATNADYRGSGFD RGHLAAAANHRWSQKAMDDTFYLSNVAPQVPHLNQNAWNNLEKYSRSLTRTYQNVYVCTGPLFLPRTEAD GKSYVKYQVIGKNHVAVPTHFFKVLILEAAGGQIELRSYVMPNAPVDEAIPLEHFLVPIESIERASGLLF VPNILARAGSLKAITAGSK |
| AAW33811.1 | R.HinP1I | 16 | >gi|57116674|gb|AAW33811.1|R.HinP1I restriction endonuclease [Haemophilus influenzae]<br>MNLVELGSKTAKDGPKNEKDIADRPENWKENSEAQDWLVTMGHNLDEIKSVKAVVLSGYKSDINVQVLVF YKDALDIHNIQVKLVSNKRGFNQIDKHWLAHYQEMWKFDDNLLRILRHFTGELPPYHSNVKDKRRMFTE FSQEEQNIVLNWLEKNHVLVLTDILRGRGDFAAEWVLVAQKVSNNARWILRNINEVLQHYGSGDISLDPR GSINFGRVTIQRXGGDNGRETANMLQFKIDPTELFDI |
| AAO93095.1 | I-BasI | 17 | >gi|29838473|gb|AAO93095.1| I-BasI [Bacillus phage Bastille]<br>MFQBEWKDVTGFEDYYEVSNKGRVASKRTGVIMAQYKINSGYLCIKFTVNKKRTSHLRLVAREFCEGY SPELDVNHKDTDRMNNYNDNLEWLTRADNLKDVRERGKLNTHTAREALAKVSKKAVDVVTKDGSEYIATY PSATEAAEALGVQGAKISTVCHGKRQHTGGYYHFKFNSSVDPNRSVSKK |
| AAK09365.1 | I-BmoI | 18 | >gi|12958590|gb|AAK09365.1|AF321518_2 intron encoded I-BmoI (Bacillus mojavesia)<br>MKSGVYKITNTGKFYIGSSEDCESRLKVHFRNLKNNRHINRYLNNSFNEBGEQVFIGEVIHILPIEEA IAKEQYIDNFYEEMYNISKSAYHGGDLTSYHPDKRNIILKRADSLKKVYKMTSEEKAKRWQCVQGENN PMFGRKHTETTKLLKISNHNKLYYSTKNPFKGKKHSEESKTKLSEYASQRVGEKNPFYGKTHSDEFKTYM SKKFKGRKPKNSRPVIIDGTEYEASATEASPQLNVVPATILHRIKSKNEKYSGYFYK |
| P34081.1 | I-HmuI | 19 | >gi|46541|sp|P34081.1|HMUI_BPSP1 RecName: Full = DNA endonuclease I-HumI, AltName, Full = HNH homing endonuclease I-HmuI<br>MEWKDIKGYEGHYQVSNTGEVYSIKSGKTLKHQIPKDGYHRIGLFKGGKGKTPQVHRLVAIHPCEGYEBG LVVDHKDGNKDNNLSTNRWTQKINVEQMSRGTLNVKAQQIAKIKNQKPIIVISPDGIEKEYPSTKC ACEELGLTRGKVTDVLKGHRIHHKGYTPRYKLNG |
| P13299.2 | I-TevI | 20 | >gi|6094464|sp|P13299.2|TEV1_BPT4 RecName: Full = Intron-associated endonuclease 1; AltName: Full = I-TevIy AltName: Full = IRF protein<br>MKSGLYQIKNTKNNVYVGSAKDFEKRWKRHFKDLEKGCHSSIKLQRSFNKHGNVFECSILEEIPYEKDL IIERENFWIKELNSKINGYNIADATFGDTCSTHPLKEEIIKKRSETVKAKMLKIGPDGRKALYSKPGSKN GRWNPETHKFCKCGVRIQTSAYTCSKCRNRSGENNFFNHKHSDITRSKISEKMKGKKPSNIKKLSCDGV IFDCAADAARHFKISSGLVTYRVKSDKWNWFYINA |
| P07072.2 | I-TevII | 21 | >gi|20141823|sp|P07072.2|TEV2_BP74 RecName: Full = Intron-associated endonuclease 2; AltName: Full = I-TevII<br>MKWKLRKSLKIANSVAFTYMVRFPDKSFYIGFKKFTIYGKDTNWKEYNSSSKLVKEKLKDYKAKWIILQ VFOSYESALKHEEMLIREYFNNEFILNKSIGGYKFNYPDSEEHKQKLSNAHKGKILSLKHKDKIREKLI |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| AAF19759.1 (reference) | Vvn_CLS | 29 | VSGVSYGRCEHQNPFGRNVMPQTELRGSIARTYLYMSQEYGPQLSKGGGLMQARDKSYPVDEWSCTRD DRIAEIQGNHHPFVQQSGQTQ |
| | | | >Vvn_CLS (variant of AAF1759.1) MASGAPPSSPSAAXQQAVVIYQDHPISFYCGCDISNQGFXGLPGLETCGKQVRKQQTHASRLEWERVVPA WQFGHHPQCWGKGGWCSFNGGGPRLKSALLBNLTPAIGEVNGDPSNPSQNNGVDGVSYGRCENQVN FKQRKVMPPDRARGSIARTYLYMSEQYGPQLSKQQQQLMQAWNKSYPVDEWECTRDDRIAKIQGNHNPFV QQSCQTQGSSAD |
| P00644.1 | Staphylococcal nuclease (NUC_STAAU) | 30 | >gi|128852|sp|P00644.1|NUC_STAAU RecName: Full = Thermonuclease; Short = TNase; AltName: Full = Micrococcal nuclease; AltName: Full = Staphylococcal nuclease; Contains: RecName: Full = Nuclease B; Contains: RecName: Full = Nuclease A; Flags: Precursor MLVMTEYLLSAGICMAIVSILLIGMAISNVSKGGYAKRFFFATSCLVLTLVVVSSLSSSANASQTDNGV NRSGSEDPTVYSATSTKKLHKEPATLIKAIDGDTVKLMYKGQPMTFRLLLVDTPETKHPKKGVEKYGPEA SAFTKKMVENAKKILEVEFDKGQRTDKYGRGLAYTYADGKMVNEALVRQGLAKVAYVYKPNNTHEQHLRKS EAQAKKEKLNIWSEDNADSGQ |
| P43270.1 | Staphylococcal nuclease (NUC_STAHY) | 31 | >gi|1171859|sp|P43270.1|NUC_STAHY RecName: Full = Thermonuclease; Short = TNase; AltName: Full = Micrococcal nuclease; AltName: Full = Staphylococcal nuclease; Flags: Precursor MKKITTGLIIVVAAIIVLSIQFMTESGPPFKSAGLSNANEQTYKVIRVIDGDTIIVDKGKQQNLRMIGVD TPETVKPNTPVQPYGKEASDFTKRHLTNQKVRLEYDKQEKDRYGRTLAYVWLGKEMFNEKLAKEGLARAK FYRPNYKYQERIEQAQKQAQKLKENIWSN |
| P29769.1 | Micrococcal nuclease (NUC_SHIFL) | 32 | >gi|266681|sp|P29769.1|NUC_SHIFL RecName: Full = Micrococcal nuclease; Flags: Precursor MKSALAALRAVAAAVVLIVSVPAWADFRGEVVRILDGDTIDVLVNRQTIRVRLLADIDAPESQAFGSRAR QPLADLTFRQEVQVTEKEVDRYGRTLGVVYAPLQYPGGQTQLTNINAIMWQEGMAWAYRYYGKPTDAQMY EYEKEARRARLGLWSDPNAQEPWKWRRASKNATN |
| p94492.1 | Endonuclease yncB | 33 | >gi|81345826|sp||YNCB_BACSU RecName: Full = Endonuclease nuclease; Flags: Precursor MKKIGISMIAIVLSITLAACGSNHAAKNHSDSNGTEQVSQDTHSNEYNQTEQKAGTPHSKNQKKLIVNTL DRAIDGDTIKVIKNGKKDTVRYLLVDTPETKPMSCVQPYGSDASKRNKELVNSGKLQLEFDKGDRRDKY GRLLAYVYVDGKSVQETLLKEGLARVAYVYEPNTKYIDQPRLDBQEAKSDKLSIWSKSGVTNRGFNGCV K |
| P00641.1 | Endodeoxyribonuclease 1 (ENRN_BPT7) | 34 | >gi|119370|sp|P00641.1|ENRN_BPT7 RecName: Full = Endodeoxyribonuclease 1; AltName: Full = Endodeoxyribonuclease I; Short = Endonuclease MAGYGAKGIRKVGAFRSGLEDKVSKQLESKGIKFEYEEMKVPVVIPASNHTYTPDFLPNGIFVETKGLW ESDDRKKHLLIREQHPELDIRIVFSSSRTKLYKGSPTSYGEFCEKHGIKFADKLIPAEWIKEPKKEVPFD RLKRKGKKK |
| Q53H47.1 | Metnase | 35 | >gi|74740552|sp|Q53H47.1|SETMR_HUMAN RecName: Full = Histone-lysine N-methyltransferase SETMAR; AltName: Full = SET domain and mariner transposase fusion gene-containing protein; Short = HsMar1; Short = Metnase; Includes: RecName: Full = Histone-lysine N- |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| | | | methyltransferase; Includes: RecName: Full = Mariner transposase Hsmar1 MAEFKEKPEAPTEQLDVACGQENLPVGAWPGAAPAPFQYTPDHVGPGADIDPTQITFPGCTVKTPCL PGTCSCLRHGENYDSNSCLRDIGSSGGKYAEPVFECNVLCRCSDHCRNRVVQKGLQFHPQVFKTHKKGWGL RTLEFIPKGRFVCEYAGEVLGFSEVQRRIHLQTKSDSNYIIAIREHVYNGQVMETFVDPTYIGNIGRFLN HSCEPNLLMIPVRIDSMVPKLALFAAKDIVPEEELSYDYSGRYLNLTVSEDKERLDHGKLRKPCYCGAKS CTAFLPFDSLYCPVEKSNISCGNEKEPSMCGSAPSVFPSCKRLTLETMKMMLDKQIRAIFLFEFKMGR KAAETTRNININAFGPGTANERTVQWWFKKFPCKGDESLEDEERSGRPSEVDNDQLRAIIEADPLTTREVA EELNVNHSTVVRHLKQIGKVKKLDKWVPHELTENQKNRRFEVSSLILRNHNEPFLDRIVTCDEKWILYD NRRRSAQWLDQEEAPKHFPKPILHPKKVMVTIWWSAAGLIHYSFLNPGETITSEKYAQEIDEMNQKLQRL QLALVNRKGPILLHDNARPHVAQPTLLQKNLELGYEVLPHPPYPDLLPYNYHVKHLNNFLQGKRFHNQQ DAENAFQEFVESQSTDFYATGINQLISRWQKCVDCNGSSYFD |
| ABD15132.1 | Nb.BsrDI | 36 | >gi|86757493|gb|ABD15132.1| Nb.BsrDI [Geobacillus stearothermophilus] MTEYDLHLYADSFHEGHWCCENLAKIAQSDGGKHQIDYLQGFIPRHSLIFSDLIINITVFGSYKSWKHLP KQIKDLLFWGKPDFIAYDPKNDKILFAVEETGAVPTGNQALAWCERIYGSARKQIPFWILLSEFGQHKDG GTRRDSIWPTIMGLKTQLVKTPSIILHYSDINNPEDYNSGNGLKFLFKSLLQIINYCTLKNPLKGMLE LLSIQYENMLEFIKSQWKEQIDFLPGEEILNTKTKELARMYASLAIGQVTKIPEBELFNWPRTDKVNFKSP QGLIKYDELCYQLEKAVGSKKAYCLSNNAGAKPQKLESLKEWINSQKKLFDKAPKLTPPAEFNMKLDAFP VISNNNYYVTSKNILYLFDYWKDLRIAIETAFPRLKGKLPTDIDEKPALIYICNSVKPGRLFGDPFTGQ LSAFSTIFGKKNIDMPRIVVAYYPHQIYSQALPKNNKSNKGITLKKELTDFLIFHGGVVKLNEGKAY |
| ABD15133.1 | BsrDI A | 37 | >gi|86757494|gb|ABD15133.1| BsrDI A [Geobacillus stearothermophilus] MTDRDLHLYADSFHEGHWCCENLAKIAQSDGGKHQIDYLQGFIPRHSLIFSDLIINITVFGSYKSWKDIL VWNNNYYVTTSKNILYLFDYWKDLRIAIETAFPRLKGKLPTDIDEKPALIYICNSVKPGRLFGILMGETS QKDIDNAELCYQLEKAVGSINTPLSNNAGAKPQKLESLKEWINSQKKLFDKAPKLTPPAFEPTGLKHLL EKLAVLM |
| ABN42182.1 | Nt.BspD6I (R.BspD3I large subunit) | 38 | >gi|125396536|gb|ABN42182.1| heterodimeric restriction endonuclease R. BspD6I large subunit [Bacillus sp. D6] MAKKVDWYSCSPPSKKIPQELKVLAKGSGSYWSGSYWKAGPAKEKLAALPQFLGTTYKKEALFSEK DRVAPMYTYSKLDLMPLCLTATMNAVVDSLSEEIMAPNSERWKKLLEYEFTSNIPPRFEKIYGKGN VLSGGKKGGLSKLDLAMPCLTATMMQVDSLLEEIMCPNRERCIQGAMDIDEYISSKIDSSEKVDNN VDKIRESDDSSEGFIEGKGMIVADTTPPTLLFVAAQLVGNPEYDDIEGIYSSEDIYISYNSLKVFN VGPVSSHVYYGNEGEGYQLLDAEKRIHDENTTLAEQGLTDIDEKPALIYICNSVSRSIAVFEML DVETLKDVVKYGNEGEGYQLLDAEKRIHDENTTLAEQGLTDIDEKPALIYICNSVSRSIAVFEML TWQGLLDVYQELLKKKFLEQDDFNWDPRQLEEVIQLLVIQLLEVYASRVISRRKQSWMSEPVTRHY WNKPRELKKPIAAPAFEKFNITIIWINSQKKLFDKAPKLTPPAFEPIINYCTLKNPLKGMLERSE SYDIKNLMVSLYRTTIECERKYTQIKAGLEETLNNMVVDKEVRF |
| ABN42183.1 | ss.BspD6I (BspD3I small subunit) | 39 | >gi|125396997|gb|ABN42183.1| heterodimeric restriction endonuclease R.BspD6I small subunit [Bacillus sp. D6] MQDILDFYEEVEKTINPPNVFEWNTYRVFKKLGSYKNLVPNFKLDDSGHPIGNAIPGVEDILVEYEHFSI LIECSLTIGEKQLDYEGDSVVRHLQEYEAYTLFLGKSIDLSFARHIGFNKSSEPVIPLTVDQFKK LVTQLKGDGEHFENPNKLKEILIKLLRSDLGYDQAEEWLTFIEYNLK |
| AAK27215.1 | RPleI | 40 | >gi|13448813|gb|AAK27215.1| AF355461_2 restriction endonuclease R.PleI [Paucimonas lemoignei] MAKPIDSKVLFITTSPRTPEXMVPEIELLDKNFNGDVWNKDTQTAFMKILKEESFFDGEGKNDPAFSARO |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| AAK39546.1 | MlyI | | RINRAPKSLGFVILTPKLSLTDAGVELIKAKRDDIFLRQMLKFQLPSPYKKLSDKAALFYVKPYLEIFR LVRRHFGSLITFDELMIFGLQLIDERIPNQIVDKIRDFRVGKIENKGRYKTYKKERFEEELGKIYKDELFGL TEASAKTLITKKGNNMRDYADACVRYLRATGMVNSYQGKSLIVQEKKEEVDFFLKNTEREPCFINDEA SYVSYLGNPNYPKLFVDDVDRIKKKLRFDFKKTNKVNALTLPELKEELENEILSRKENILKSQISDIKNP KLYEDIQEVFEKIENDRTLSDAPLMLEWNTWRAMTMLDGGEIKANLKFDDFGSPMSTAIGNMPDIVCEYD DFQLSVEVTMASGQKQYEMEGEPVSRHLGKLKKSSEKPYYCLFIAPKINPSSVAHFFMSHKVDIEYYGGK SLIIPLELSVFRKMIEDTFKASYIPKSDNVHKLFKNPASIADEAGNEKVWYEGVKRATAMNWLSLS |
| AAK39546.1 | MlyIR | 41 | >gi\|13786046\|gb\|AAK39546.1\|AF355462_2 MlyIR (Micrococcus lylae) MASLSKTKHLFGFTSPRTIEKIIPELDILSQQFSGKVWGENQINFFDAIFNSDFYEGTTPQDPALAARD RITRAPKALGPIQLKPVIQLTKAGNQLVNQKRLPELFTKQLLKFQPLPSPYHTQSPTVNFNVRPYLELLRL INELGSISKTEIALFFLQLVNYNKPDEIKNKILKFRETRKNNRSVSWKTYVSQEFEXQISIIFADEVTAK NFRTRESSDESFKKFVKTKEGNMKDYADAPFRYIRGTQLVTIDKNLHLKISSLKQDSVDFLLKNTDRNAL NLSLMEYENYLFDFDQLIVLEDNSGLINSKIKQLDDSINVESLKIDDAKDLLNDLEIQRKAKTIEDTVNH LKLRSDIEDILDVFAKIKKRDVPDVPLFLEWNIWRAFAALNHTQAIEGNFIVDLDGMPLNTAPGKKPDIE INYGSFSCIVEVIMSSGETQFNMEGSSVPRHYGDLVRKVDHDAYCIFIAPKVAPGTKAHFPNLNRLNSTKH YGGKTKIIPMSLDDFICELQVGITHNFQDINKLKNWLDNLINPNLESEDEIWPEEIISKISTWAI |
| YP_004134094.1 | AlwI | 42 | >gi\|319768594\|ref\|YP_004134094.1\| restriction endonuclease, type II, AlwI [Geobacillus sp. Y412MC52] MNKKNTRKVWFITRPERDPRFHQEALLALQKATDDFRLKWAGNREVHKRYEEELANMGIKRNNVSHDGSG GRTWMAMLKTFSYCYVDDDGYIRLTKVGEKLIQGEKVYENTRKQVLTLQYPNAYFLEPGFRPKPDEGFRI RPVLFLIKLANDERLDFYVTKEEITYFAMTAQKDSQLDEIVHKILAFRKAGPREREEMKQDIAAKPDHRE RSDXGARDFYEAHSDVAHTFMLISDYTGLVEYYRGKALKGDSSKINEIKQEIAEIEKRYPFNTRYMISLE RMAENSGLDVDSYKASRYGNIKPAANSSKLRAKAERIIAQFPSIESMSKEEIAGALQKYLSPRDIEKVIH EIVENKDDFEGINSDFVETYLNEKDNLAFEDKTGQIFSALGFDVAMRPKAKNGERTEIEIIARYGGSKPG IIDAKNYAGKFPLSSSLVSMMASEYIPNYTGYEGKELTFFGYVTANDFSGERNLEKISDKAKRITGNPIS GFLVTARTLLGFLDYCIENDVPLEDRAELPVKAVKNKGYKSLEALLRELKETI |
| AAY97906.1 | Mva1269I | 43 | <gi\|68480350\|gb\|AAY97906.1\| Mva1269I restriction endonuclease [Kocuria varians] MYLNTAVFNIYGDNIVECCSRAFHYILEGFKLANISITQEYDLQNITTPKFCIYTDKFRYIFIFIPGTSAS RWNKDIYKELVLNNGGPLKEGADAIITRIPSEDSELVIASMEFSAALPAGNNTWQRSGRAYSLTAANIPY FYIVQLGGKEIKKGKDGKSDKFAITRLPNPALSLSFTLNTIKKPAPSLIVVDQAPEADSAISDLYSNCYGI DDFSLYLFLITEENNLHELKNIYNKNVEFHKFQLRSVDKNFSGKDYKYTFEHKDPPYKGLTEVVKERKI PWKKKTATKIFENPPLRNQAPIFRLIDFLSTKSGIVSKDSLPLTFIPSEHRVEVANYICNQLYIDKVSD EFVXWIYKKEDLAICIINGFKPGGDSRPDRGLPPFTKMLTNLDITLMFGPAPPTQWDYLDSDPEKLNK TNGLWQSIPAFSDAILVDSSTRDNNKFVTNAYLKEMWVQREKKESNTPISYFRKSVGEHDVDTSLMILF TYIGKHFESACNPPGGWSGVSLLKNNIEYRWTSMYRVSQDGTKRPDHIYQLVYNSTDTLLIESJGUJB DLLKSKEANVGIGMINYLKNLMARDYTAVKKDGEWKNIHGQMTLDKFLTFSAVAYLFTTDFDNEYTSAAE LLVHSNTQLAFALEIKENNSVMHIFTANTVAYNFAEYLLETMRNSHLPKIYKPI |
| ADR72996.1 | BsrI | 44 | >gi\|313667100\|gb\|ADR72996.1\|BarI [Geobacillus stearothermophilus] MRNIRIYSEVKEQGIFFKEVIQSVLEKANVEVLVNSAMLDYSDVISLIRNQKKFDLLVSEVRDKRSI PIVMVEFSTAVTTDDHELQRADAMFWAYKYKIPYLKISPMEKKSQTADDKFGGGRLLSVNDQIIHMYRTD GVMYHIEWESMDRSAYVKNAELYPSCPDCAPELASLPRCLLETIEKCKNIRDYRILLDLKGQKVAVKW GNFREEXTLEQWKHEKFDLLERFSKSSSRMEYDKDKKELKIKVNRYGHAMDPERGILAFWKLVLGDEWKI VAEFQLQRKTLKGRQSYQSLFDEVSQEEKLMNTASEIIKNGNVISPDKAIEIHKLATSSTMISTIDLGTP |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| | | | ERKYITDDSLKGYLQHGLITNIYKNLLYYVDEIRFTDLQRKTIASLTWNKEIVNDYYKSLMDQLLDKNLR VLPLTSIKNISEDLITWSSKEILNLGYKILAASYPEAQGDRCILVGPTGKKTERKFIDLIAISPNSKGV ILLECKDKLSKSKDDCEKMNDLLNHNYDKVTKLINVLNINNYNNIIYTGVAGLIGRKNVDNLPVDEVI KFKYDAKNLKLNWEINEDIILOKHSGSFSMEDVAVVRKRS |
| AAL86024.1 | BsmI | 45 | >gi\|19347662\|gb\|AAL86024.1\| BsmI [Geobacillus stearothermophilus] MNVFRIHGDNIIECERVIDLILSKINPQKVKRGFISLSCPFIEIIFKEGHDYPHWRFDMPFGFNKNTNDR WNSNILDLLSQKGSFLYETPDVIITSLNNGKEEILMAIEPCSALQAFNQAWQRSGRAYSVGRTGYPYIYI VDFVKYELNNSDRSRKNLRFPNPAIPYSYISHSKNTGNFIVQAYFRGEEYQPKYDKKLKFFDETIPAEDD IADYIIAKLQHRDTSNIRQLLINNLKMVEFLSHTKNDNNFTYSEWESIYNGTYRITNLPSLGRFKFRK KIAEKSLSGKVKEFNNIVQRYSVGLASSDLPFGVIRKESRNDFINDVCKLYNINDMKIIKELKEDADLIV CMLKGPKPRGDDNRPDRGALPLVAMLAGENAQIFTFIYGPLIKGAINLIDQDINKLAKRNGLWKSFVSLS DFIVLDCPIIGESTNEFRLIINKNNKESILRKTSKQQNILVDPTPNHYQENDVDTVIYSIFKYIVPNCFS GMCMNPPGGDWSGLSIIRNGHEFRWLSLPRVSENGKRPDHVIQLDLPERKPLLLSIESKEKPNDLEPKIGV QLIKYIEYLFDFTPSVQRKIAGGNWEFGNKSLVPNDFILLSAGAPIDYDNLTENDYEKIFEVTGCDLLIA IKNQNNPQKWVIKEKPKNTIAEKLVNYIKLNFKSNIFDTGFFHIEG |
| ADI24225.1 | Nb.BtsCI | 46 | >gi\|297185870\|GB\|ADI24225.1\| BtsCI bottom-strand nicking enzyme variant [synthetic construct] MKRILYLLTEERPKINIIKQIINLEYKATLHFGAKIVPVMNEENKFTFIYHVKGIEVEGFDAVLIKIVSG HSSFVDYLVFDSNDLKPEKNTITLFDLDQYELDLSYYFGKGWIVRIPSPSDLPKYVVFETKTDDHESRNT NAYQRSSKFVFCELYYGKEVKKVMLYDISDGRTLSGTDTHNFGMRMLVTNNVNLVGVPNMYLPFTDIKEF INEKNRIADNGPSHNVPIRLKLDKEKNVIYISAKLDKGNGKNKNKISNDPNIGAVAIISATLRNLNWKGD IEIINHNLLPSSISSRSNGNKLLYIMKKLGVRPNNINVWNNIKNNINFFYNITSEKIVSIYYHLYVED KLSNARVIFDNHAGCGKSYFRTLNNKIIPVGKEIPLPALVIFDSDQNIVKVIAAAKAENVYNGVEQLSTF DKFIESYINKYYPGAAVECSVITWGKSSNPYVSFYLDKDGSAVFL |
| ADI24224.1 | Nt.BtsCI | 47 | >gi\|297185869\|GB\|ADI24224.1\|BtsCi top-strand nicking enzyme variant [synthetic construct] MKRILYLLTEERPKINIIHQIINLEYKATLHFGAKIVPVMNEENKFTFIYHVKGIEVEGFDAVLIKIVSG HSSFVDYLVFDSNDLKPEKNTITLFDLDQYELDLSYYFGKGWIVRIPSPSDLPKYVVFETKTDDHESRNT NAYQRSSKFVFCELYYGKEVKKVMLYDISDGRTLSGTDTHNFGMRMLVTNNVNLVGVPNMYLPFTDIKEF INEKNRIADNGPSHNVPIRLKLDKEKNVTYISAKLDKGNGKNKNKISNDPNIGAVAIISATLRNLNWKGD IEIINHNLLPSSISSRSNGNFLLYIMEKLGVRFNNINVWNNIENNNINYFFYNITSEKIVSIYYHLYVED KLSNARVIFDNHAGCGKSYFRTLNNKIIPVGKEIPLPDLVIFDSDQNIVKVIAEKAEVYNGVEQLSTF DKFIESYINKYYPGAAVECSVITWGKSSNPYVSFYLDKDGSAVFL |
| | R1.BtaI | | >gi\|85720924\|gb\|ABC75874.1\|R1.BtaI [Geobacillus thermoglucosidasius] MKITEGIVHVAMRHFLKSNGWKLLAGQYPGGSDDELTALNIVDPVVARDNSPDPRRHSLGKIVPDLIIAYK NDDLLVIEAKPKYSQDDRDKLLYLLSERKHDFYAALEKFATERNHPELLPVSKKLNIIPGLAFSASENKPK KDPGFVYIRVSGIFEAFMEGYDWG |
| ABC75874.1 | R1.BtsI | 48 | >gi\|85750924\|gb\|ABC75874.1\|R1.BtsI [Geobacillus thermoglucosidasius] MKITEGIVHVAMRHFLKSLGWKLLAGQYPGGSDDELTALNIVDPVVARDNSPDPRRHSLGKIVPDLIAYK NDDLLVIEAKPKYSQDDRDKLLYLLSERKHDFYAALEKFATERNHPELLPVSKKLNIIPGLAFSASENKFK KDPGFVYIPVSGIFEAFMEGYDWG |
| ABC75876.1 | R2.BtsI | 49 | >gi\|85720926\|gb\|ABC75876.1\|R2.BtsI [Geobacillus thermoglucosidasius] MQIEQLMKSLTIYFPDIQEGLWFKNLHPLLESASLEAITGSLKRNPNLADVLKYDRPDIILTLNQTFIIV |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| | | | IERTIEVPSGHNVQQRGRLAAASEAGVPLVYFGPYAAPKNGGATEGPRYMNLRLPYALDVMQKVNGSAI TTINMPVDQNFEILQDPSKDKRMKEYLEMFPDNLLKYGIAGINLAIRNSSFQAEQLAEREKFVETMITNP WQYDVPPDSVQILNAERFFNELGISENKRIICDEVVLYQVGMTYVFSDPYTGMALLYKYIYILGSERNRC LILKFPNITTDMWKKVAFGSREFKDVRIYRSVSDGTLFADGYLSKEEL |
| AAX14652.1 | BbvCI subunit 1 | 50 | >gi|60202520|gb|AAX14652.1|BbvCI endonuclease subunit 1 [Brevibacillus brevis]<br>MINEDFFIYEQLSHKKNLEQKGKNAFDEETEELVRQAKSGYHAPIEGINYDEVTKLDLNSSVAALEDYIS IAKEIBKKHKMFNWRSDYAGSIIPEFLYRIVHVATVKAGYHAKIEGINYDEVTKLDLNSSVAALEDYIS FALGPHEVDVKIASESHRVISLAVACVETNIDKNKLNGLDPSAERMKRTYPGSAYFLITETLDFSPDEN HSSGLIDEIYVLRKQVRTKNRVQKAPLCPSVFAEELLEDILEISYRASNVKGHVVDRLEGGKLIRV |
| AAX14653.1 | BbvCI subunit 2 | 51 | >gi|60202521|gb|AAX14653.1|BbvCI endonuclease subunit 2 [Brevibacillus brevis]<br>MFNQFNPLVYTHGGKLERKSKKDKTASKVPEEFGVMEAYNCWKEASLCIQQRDKDSVLKIVAALNTYKDA VEPIFDSRLNSAQEVLQPSILLEEFFEYLFSRIDSIVGVNIPIRHPAKGYLSLSFNPHNIETLIQSPEYTV RAKDHDFIIGGSAKLTIQGHGGEGETTNIVVPAVAIECKRYLERNMLDECAGTAERLKRATPYCLYFVVA EYLKLDDGAPELTEIDEIYILRHQRNSERNKPGFKPNPIDGELLIWDLYQEVMNHLGKIWDPNSALQRGK VFNRP |
| CAA74998.1 | Bpu10I alpha subunit | 52 | >gi|2894388|emb|CAA74998.1|Bpu10I restriction endonuclease alpha<br>MGVEQEWIKNITDMYQSPELIPSHASNLLHQLREKRNEKLKKALEIITPNYISYISILLNNHMTRKEI VILVDALNEYMNTLRHPSVKSVPSHQADFYSSVLPEFFNLFRNLIKGLNEKIKVNSQKDIIIDCIFDPY NEGRVVFKKKRVDVAIILNKNFVFNNVEISDFAIPLVAIEIKTNLDKNMLSGIEQSVDSLKETFPLCLYY CITELADFAIEKQNYASTHIDEVFILRKQKRGPVRRGTPLEVVHADLLIEVVEQVGEHLSKFEDPIKTLK ARMTEGYLIKGKGK |
| CAA74999.1 | Bpu10I beta subunit | 53 | >gi|2894389|emb|CAA74999.1|Bpu10I restriction endonuclease beta subunit [Bacillus pumilus]<br>MTQIDLSNTKHGSILFEKQKNVKEKYLQQAYEHYLYPRSSIDGLEITNDEAIFKLTQAANNYRDNVLYLP ESRPNSGQEAFRYTILEEEPYWLFKDLVKKKFNQEPSSIVMGKANSYVSLSFSPESFLGLYENPIPYIHT KDQDPVLGCAVDLKISPKNELNKENETEIVVPVIAIECKTYIERNMLDSCAATASRLKAAMPYCLYIVAS EYMKMDQAYPELTIDEVFILCKASVGERTALKKGLPHKLDENLMVELFHMVERHLNRVWWSPNEALS RGRVIGRP |
| ABM69266.1 | BmrI | 54 | >gi|123187377|gb|ABM69266.1|BmrI [Bacillus megaterium]<br>MNYFSLHPNVYATGRPKGLINMLESVWISNQKPGDGTMYLISGFANYNGGIRFYETFTEHINHGGKVIAI LGGSTSSQRLSSKQVVAELVSRGVDVYIINRKRLLHAKLYGSSSNSGESLVVSSGNFTGPGSQNVEASLL LDNNTTSSMGFSWNGMVNSMLDQKWQIHNLSNSNPTSPSWNLLYDERTNLTLDDTQKVTLTLTLGHADT ARIQAAPKSKAGEGSQYFWLSKDSYDFFPPLTIRNKRGTKATYSCLINMNYLDIKYIDSECRVTFEAENN FDFRLGTGKLRYTNVAASDDIAAITRVGDSDYELRIIKKSSNYDALDSAAVNFIGNRGKRYGIPNDEF GRIIGAKF |
| CAC12783.1 | BfiI | 55 | >gi|10798463|emb|CAC12783.1|restriction endonuclease BfiI [Bacillus firmus]<br>MNFFSLHFNVYATGRPKGLIGMLENVWSNHTPGEGTLYLISGFSNYNGGVRFYETFTEHINQGGRRVIAI LGGSTSSQRLSSRQVVEELLNRGVEVHIINRKRILHAKLGTSNNLGESLVVSSGNFTGPGMSQNIEASLL LDNNTTQSMGFSWNDMISEMLNQNWHIHNMTNATDASPGWNLLYDERTTLTLDETSRVTLIVTLGHADT |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| | | | ARIQAAPGTTAGQGTQYFWLSKDSYDFFPLTIRNRRGKATYSSLINMNYIDINYTDTQCRVTFEAENN FDFRLGTGKLRYTGVAKSNDIAATRVGDSDYERIIKQGTPEHSQLDPYAVSFIGNRGKRFGYISNEEP GRIIGVTF |
| P05725.1 | I-CreI | 1 | <gi|140470|sp|P05725.1|DNE1_CHLRE RecName: Full = DNA endonuclease I-CreI, AltName: Full = 23S rRNA intron protein MNTKYNKEFLLYLAGFVDGDGSIIAQIKPNQSYKFKHQLSLAFQVTQKTQRRWFLDKLVDEIGVGYVRDR GSVSDYILSEIKPLHNFLTQLQPFLKLKQKQANLVLKIIWRLPSAKESPDKFLEVCTWVDQIAALNDSKT RKTTSETVRAVLDSLSEKKKSSP |
| Q9UQ84.2 | hExoI (EXO1_HUMAN) | 56 | <gi|85700954|sp|Q9UQ84.2|EXO1_HUMAN RecName: Full = Exonuclease 1; Short = hExoI; AltName: Full = Exonuclease I, Short = hExoI MGIQGLLQFIKEASEPIHVRKYKGQVVAVDTYCWLHKGAIACAEKLAKGEPTDRYVGFCMKFVNMLLSHG IKPILVFDGCTLPSKKEVERSRRERQANLLKGKQLLREGKVSEARECFTRSINITHAMAHEVIKAARSQ GVDCIVAPYEADAQLAYLNKAGIVQAIITEDSDLLAFGCKKVILKMDQFGNGLEIDQARLGMCRQLGDVF TEEKFRYMCILSGCDYLSSLRGIGLAKACKVLRLANNPDIVKVIKKIGHYLKMNITVPEDYINGFIRANN TFLYQLVFDPIKRKLIPLNAYEDDVDPETLSYAGQYVDDSIALQIALGNKDINTFEQIDDYNPDTAMPAH SRSHSWDDKTCQKSANVSSIWHRNYSPRPESGTVSDAPQLKENPSTVGVERVISTKGLNLPRKSSIVKRP RSAELSEDDLLSQYSLSFTKTKKNSSEGNKSLSFSEVFVPDLVNGPTNKKSVSTPPRTRNKFATFLQRK NEESGAVVVPGTRSRFFCSSDSTDCVSNKVSIQPLDETAVTDKENNLHESEYGDQEGKRLVDTDVARNSS DDIPNNHIPDGDHIPDKATVFTDEESYSFESSKFTRTISPPTLGTLRSCFSWSGGLGDFSRTPSPSPTAL QQFRRKSDSPTSLPENNMSDVSQLKSEESSDDESHPLREEACSSQESGEFSLQSSNASKLSQCSSKDS DSEESDCNIKLLDSQSDQTSKLRLLSHFSKKDTPLRNKVPGLYKSSSADSLSTTKIKPLGPARASGLSKKP ASIQKRKHHNAENKPGLQIKLNELWKNFGFKKDSEKLPCKKPLSPVRDNIQLTPEAEEDIFNKPECGRV QRAIFQ |
| P39875.2 | Yeast ExoI (EXO1_YEAST) | 57 | <gi|1706421|sp|P39875.2|EXO1_YEAST RecName: Full = Exodeoxyribonuclease 1; AltName: Full = Exodeoxyribonuclease I, Short = Exo I; Short = Exonuclease I; AltName: Full = Protein DHS1 MGIQGLLPQLKPIQMPVSLRRYEGEVLAIDGYAWLHRAACSCAYELAMGKPTDKYLQFFIRRFSLLKTFK VEPYLVFDGAIPVKKSTESKRRDKRKENKAIAERLWACGEKKNAMDYFQKCVDITPEMAKCIICYCKLN GIRYIVAPFEADSQMVYLEQKNIVQGIISEDSDLLVFGCRRLITKLNDYGECLEICRDNPIKLPKKFPLG SLTNEEIITMVCLSGCDYTNGIPKVGLITAMKLVRRFNTIERIILSIQREGKLMIPDTYINEYEAAVLAF QFQRVFCPIRKKIVSLNEIPLYLKDTESKRKRLYACIGFVIHRETQKKQIVHFDDDIDHHLHLKIAQGDL NPYDFHQPLANREHKLQLASKSNIEPGKTNTTNSEAKVKPIESFQKMTKLDHNPKVANNIHSLRQAEDK LTMAIKRKLSNANVVQETLKDTRSKFFNKPSMTVVENFKEKGDSIQDFKEDTNSQSLEEPVSESQLSTQ IPSSFITTNLEDDDNLSEEVSEVVSDIEEDRKNSEGKTIGNEIYNTDDGDTSEDYSETAESRVPTSS TTSPFGSSQRSISGCTKVLQKFRYSSSSFSGVNANRQPLPPRHVNQKSRGMVYVNQNRDDDCDDNDGKNQI TQRPSLRKSLIGARSQRIVIDMKSVDERKSFNSSPILHEESKKRDIETTKSSQARPAVRSISLLSQFVYK GK |
| BAJ43803.1 | E. coli ExoI | 58 | <gi|315136644|dbj|BAJ43803.1|exonuclease I [Escherichia coli DH1] MMNDGKQQSTFLFHDYETFGTHPALDRPAQFAAIRTDSEFNVIGEPEVFYCKPADDYLPQPGAVLITGIT PQEARAKGENEAAFAARIHSLFTVPKTCIIGYNNVRFDDEVTRNIFYRNFYDPYAWSQQHDNSRWDLLDV MRACCYALRPEGINWPENDDGLPSFRLEHLTKANGIEHSNAHDAMADVYATIAMAKLVKTRQPRLFDYLFT HRNHKLMALIDVPQMKPLVHVSGMFGAWRGNTSWVAPLAWHPENRNAVIMVDLAGDISPLLELDSDTLR ERLYTAKTDLGDNAAVPVKLVHINKCPVLAQANTLRPEDADRLGINRQHCLDNLKILRENPQVREKVVAI |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| Q9BQ50.1 | Human TREX2 | 59 | FAEAEPFTPSDNVDAQLYNGFFSDADRAAMKIVLETEPRNLPALDITFVDKRIEKLLFNYRARNFPGTLD YAEQQRWLEHRQVFTPEFLQGYADELQMLVQQYADDKEVALLKALWQYAEEIV<br><gi\|47606206\|sp\|Q9BQ50.1\|TREX2_HUMAN RecName: Full = Three prime repair exonuclease 2; AltName: Full = 3'-5' exonuclease TREX2<br>MGRAGSPLPRSSWPRMDDCGSRSRCSPTLCSSLRTCYPRGNITMSEAPRAETFVFLDLEATGLPSVEPEI AELSLFAVHRSSLENPEHDESGALVLPRVLDKLTLCMCPERPFTAKASEITGLSSEGLARCRKACFDGAV VRTLQAFLSRQAGPICLVAHNGPDYDFPLLCAELRRLGARLPRDTVCLDTLPALRGLDRAHSHGTRARGR QGYSLGSLFHRYFPRAEPSAAHSAEGDVHTLLLIFLHRAAELLAWADEQARGWAHIEPMYLPPDDPSLEA |
| Q91XB0.2 | Mouse TREX1 | 60 | <gi\|47606196\|sp\|Q91XB0.2\|TREX1_MOUSE RecName: Full = Three prime repair exonuclease 1; AltName: Full = 3'-5' exonuclease TREX1<br>MGSQTLPHGHMQTLIFLDLEATGLPSSRPEVTELCLLAVHRRALENTSISQGHPPPVPRPPRVVDKLSLC IAPGKACSPGASEITGLSKAELEVGRQRPFDDNLAILLRAFLQRQPQPCCLVAHNGDRYDFPLLQTELAR LSTPSPLDGTFCVDSIAALKALEQASPSCNGSRKSYSLGSIYTRLYWQAPTDSHTAEGDVLTLLSICQW KPQALLQWVDEHARPFSTVKPMYGTPATTGTTNLRPHAATATTPLATANGSPSNGRSRRPKSPPPEKVPE APSQBEGLLAPLSLTLTLTLAIATLYGLFLASPGQ |
| Q9NSU2.1 | Human TREX1 | 61 | <gi\|47606216\|sp\|Q9NSU2.1\|TREX1_HUMAN RecName: Full = Three prime repair exonuclease TREX1; AltName:<br>Full = DNase III<br>MGPGARRQGRIVQGRPEMCFCPPPTLPLPRILTLGTHTPTPCSSPGSAAGTYPTMGSQALPGPMQTLI FFDMEATGLPFSQPKVTELCLLAVHRCALESPPTSQGPPTVPPPRVVDKLSLCVAPGKACSPAASEIT GLSTAVLAAHGRQCFPDDNLANLLLAFLRRQPQPQCLVAHNGDRYDFPLLQAELAMLGLTSALDGAFCVDS ITALKALERASSPSEHGPRKSYSLGSIYTRLYGQSPPDSHTAEGDVLALLSICQWRPQALLRWVDAHARP FGTIRPMYGVTASARTKPRPSAVTTAHLATTRNTSPSLGESRGTKDLPPVKDPGALSREGLLAPLGLLA ILTLAVATLYGLSLATPGE |
| Q9BG99.1 | Bovine TREX1 | 62 | <gi\|47606205\|sp\|Q9BG99.1\|TREX1_BOVIN RecName: Full = Three prime repair exonuclease 1; AltName: Full = 3'-5' exonuclease TREX1<br>MGSRALPGGMPVQTLIFLDLEATGLPFSQPKITELCLLAVHRYALEGLSAPQGPSPTAPVPPRVLDKLSLC VAPGKVCSPAASEITGLSTAVLAAHGRAPADDLVNLIRTFLQRQPQPWCLVAHNGDRYDFPLLRAELAL LGLASALDDAFCVDSIAALKALEPTGSSEHGPRKSYSLGSVYTRLYGQAPPDSHTAEGDVLALSVCQW RPRALLRWVDAHAKPFSTVKPMYVITTSTGTNPRPSAVTATVPLARASDTGPNLRGDRSPKPAPSPKMCP PPGEGLLAPLGLLAFLTLAVAMYGLSLAMPGQ |
| AAH91242.1 | Rat TREX1 | 63 | <gi\|60688197\|gb\|AAH91242.1\|Trex1 protein [Rattus norvegicus]<br>MGSQALPHGHMQTLIFLDLEATGLPYSQPKITELCLLAVHPHALENSSMSEGQPPPVPKPPRVVDKLSLC IAPGKPCSSGASEITGLTTAGLEAHGRQRFNDNLATLLQVFLQRQPQPCCLVAHNGDRYDFPLLQAELAS LSVISPLDGTFCVDSIAALKTLEQASPSEHGPRKSYSLGSIYTRLYGQAPTDSHTAEGDVLALLSICQW KPQALLQWVDKHARPFSTIKPMYSGMAATTGTASPRLCAATTSSPLATANLSPSNGRSRGKPTSPPNEV PEAPSREGLLAPLGLLTFLTLAIAVLYGIFLASPGQ |
| AAH63664.1 | Human DNA2 | 64 | <gi\|19793966\|gb\|AAH63664.1\|DNA2 protein [Homo sapiens]<br>FAIPASRMEQLNELELLMEKSFWEAEBLPAELPQKKVASFPRTVLSTGMDNRYLVLAVNTVQNKEGNCE KRLVITASQSLENKELCILRNDWCSVPVSPGDIIHLEGDCTSDTWIIDKDFGYLILYPDMLISGTSIASS IRCMRRAVLSETFRSSDPATRQMLIGTVLHEVPQKAINNSFAPEKLQELAPQTIQEIRHLKEMYRLNLSQ DEIXQEVEDYLPSFCKWAGDFMHKNTSDFPQMQLSPSDNSKDNSTCNIEVVKPMDIEESIWSPRFGLK |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| | | | GKIDVTVGVKTHRGYKTKYKIMPLEKTGKSSNSIEHRSQVVLYTLLSQERHADPEAGLLLYKTGQMYP VPANHLDKRELLKLRNQMAPSLFHRISKSATRQKTQLASLPQIIEEBKTCKYCSQIGNCALYSRAVEQQM DCSSVPIVMLPKIEEETQHLKQTHLEYFSLWCLMLTLESQSKDNKNHQNIWLMPASEMEKSGSCIGNLI RMEHVKIVCDGQYLHNFQCKHGAIPVTNLMASDRVIVSGEERSLFALSRGYVKEINMTVTCLLDRNLSV LPESTLPRLDQEEKNCDIDTPLGNLSKLMENTFVSKKLRDLIIDFREPQFISYLSSVLPHDAKDTVACIL KGLNKPQRQAMKKVLLSKDYTLIVGMPGTGKTTTICTLVPAPEQVEKGGVSNVTEAKLIVFLTSIFVKAG CSPSDIGIIAPYRQQLKIINDLLARSIGMVEVNTVDKYQGRDKSIVLVSPVPSNKDGTVGELLEDWRRLN VAITRAKHKLILLGCVPSSLNCYPPLEKLLNHLNSEKLIIDLPSREHESLCHILGDFQRE |
| P38859.1 | Yeast DNA2 (DNA2-YEAST) | 65 | <gi|731738|sp|P38859.1|DNA2_YEAST RecName: Full=DNA replication ATP-dependent helicase DNA2 MPGTPQKNKRSASISVSPAKKTEEKEIQNDSKAILSKQTKRKKYAFAPINNLNGKNTKVSNASVLKSI AVSQVPNTSRTKDINKAVSKSVKQLPNSQVKPKREMSNLSRHHDFTQDEDGPMEEVIWKYSPLQRDMSDK TTSAAEYSDDYEDVQNPSSTPIVPNRLKVLSPTNIQVPNADVNQLIQENGNEQVRPKPAEISTRESLRN IDDILDDIEGDLTIKPTITKFSDLPSSPIKAPNVEKKAEVNAEEVDKMDSTGDSNDGDSLIDILTQKYV EKRKSESQITIOGNTNQKSGAQESCGKNDWTKSRGEIEDHENVDNQAKTGNAPYENEEDSNCQRIKKNEK IEYNSSDEPSDDSLIELLNETQTQVEPNTIEQDLDKVERMVSSDLRIATDSTLSAYALRAKSGAPRDGVV RLVIVSLRSVELPKIGTQKILECIDGKGEQSSVVVRMPNVYLEPEVDGVIHIIEGKNIENKRKKSDDKNP KTQLANDNLIVLNPDVLFSATSVGSSVGCLRRSIIQMQFQDPRGEPSLVMTLGNIVHELLQDSIKYXLSH NKISMSBIIIQKLDSLLETYSFSIIICNEEIQYVKELVMKEHAENILYFVNKFVSKSNGCYTSISGTRRT QPISISNVIDIEENIWSPIYGLKGFLDATVEANVENNKKHIVPLEVKTGKSRSVSYEVQGLIYTLLLNDR YEIPIEFFLLYPTRDKNMTKFPSVLHSIKHILMSRNRMSMNFKHQLQEVPGQAQSRPELPPLLRDSSCDS CPIKESCVNKLLEDGTPEESGLVEGEFELITNMLSQNLANYKEFFTKYNDLITKEESSITCVNKKLFL LDGSTRESRSGRCLSGLVVSEVVHEHEKTEGAYIYCFSRRRNDNNSQSMLSSQIAANDFVIISDEEGHFCL COGRVQFINPAKIGISVKRKLLNNRLLDKEKGVTIQSVVEESELEQSSLIATQNLVTYRIDKNDIQQSLS LARFNLLSLFLPAVSPGVIDERSKLCRKTKRSDGGNEILRSLLVDNRAPKFRDANDDPVIPYKLSKDDT TLNLNQKEADLKVMRAEDYALILGMGTGKTTVIAEIIKILVSEGKRVLLTSYTHSAVDNILIKLRNTNT SIMPLGMKHKVHPDTQKYVPNYASVKSYNDYLSKINSTSVVATTCLGINDILFTLNEKDFDYVILDEASQ ISMPVALGPLPYGNRPIMVGDHYQLPPLVENDAARLGGLEEESLFKTFCEKHPESVAELTLQYRMCGDIVT LSNFLIYDNKLKCGNNEVFAQSLELPMPEALSRYRNESANSKQWLEDIILEPTRKVVFLNYDNCPDIIEQS EKDNITNHGEAELTLQCVEGMLLSGVPCEDIGVMTLYRAQLRLLKKIFNKNVYDGLEILTADQPQGRDKK CIIISMVRRNSQLNGGALLKELRRVNVAMTRAKSKLIIIGSKSTIGSKSVPEIKSFVNLLEERNWYTMCD ALYKYKPDRSNAIDEARKGCGKRTGAKPITSKSKFVSDKPIIKEILQEYES |
| AAA45863.1 | VP16 | 66 | <gi|330318|gb|AAA45863.1|VP16 [Human herpesvirus 2] MDLLVDDLFADRDGVSPPPPAGGPKNTPAAPPLYATGRLSQAQLMPSPMPVPPAALPNRLLDDLGFSS AGPALCTMDTLWNEDLFSSGPTNADMYPECKFLSTLPSDVIDWGDAHVPERSPIDIRAHGDVAFPTLPAT RDELPSYYEAMAQPPRGELRAPEESYRTVLANFCSALYRYLRASVRQLHRQAHMRGRNRDLREMLRTTLA DRYYRETARLARVLPLHLYFLSREILWAAYAEQWMRPDLFDGLCCDLESWKRQLACLFQPLMPINGSLTV RGVPVEARRLPELNHIREHLNLPLVRSAAAEEPGAPLTTPPVLQGNQAPSSGYPMLLIRAKLDSYSSVAT SEGRSVMREHAYSRGRTPNNYGSTIEGLLDLPDDAPAEAGLVAPRMSFLSAGQPPRRLSTTAPITDVS LGDELPLDGEEVDMTPADALDDPDLEMLDGDVESPSPGMTKDPVSYGALDVDDFEEQMFTDAMGIDDFG |
| ACM07430.1 | Colicin E9 | 366 | <gi|221185856|gb|ACM07430.1|colicin E9 [Escherichia coli] MSGGDGRGHNTGAHSTSGNINGGPTGIGVSGGASDGSGWSSENNPWGGGSGGGIHWGGSGRGNGGGNGN SGGGSGTGGNLSAVAAPVAPFGPALSTPGAGGLAVSISASELSAAIAGIIALNKKVNLLPTPGVVLSSL IPSEIAKDDPNMMSKIVTSLPADDITESPVSSLPLDDKATVNVNVRVVDDVKDERQNISVVGVPMSVPVV DAKPTERPGVFTASIPGAPVLNISVNDSTPAVQTLSPGVTNNTTKDVRPAGFTQGGNTRDAVIRFPKDSG |

TABLE 2-continued

List of catalytic/enhancer domains for compact TALENs or enhanced compact TALENs.

| GENBANK/SWISS-PROT ID | NAME | SEQ ID NO | FASTA SEQUENCE |
|---|---|---|---|
| NP_775816.1 | APFL | | HNAVYVSVSDVLSPDQVKQRQDEENRRQQEWEDATHPVEAAERNYERARAELNQANEDVRNQERQAKAVQ VYNSRKSELDAANKTLADAIAEIKQFNRFAHDPMAGGHRMWQMAGLKAQRAQTDVNNKQAAFDAAAKEKS DADAALSAAQERRKQKENKEKDAKDKLDKESKRNKPGKATGKGKPVGDKWLDDAGKDSGAPIPDRIADKL RDKEFKSFDDFFKAVWEEVSKDPELSKNLNPSNKSSVSKGYSPFTPKNQQVGGRKVYELHHDKPISQGGE VYDMDNIRVTTPKRHIDIHRGK |
| P14870.1 | FokI | 367 | <gi|135233|sp|P14870.1|T2F1_PLAQK RecName: Full = Type-2 restriction enzyme FokI; Short = R.FokI1 Altname: Full = Endonuclease FokI; Altname: Full = Type II restriction enzyme FokI; Altname: Full = Type IIS restriction enzyme FokI<br>MFLSMVSKIRTPGWVQNPGKFENLKRVQVPDRNSKVHNEVKNIKIPTLVKESKIQKELVALMNQHDLIY TYKELVGTGTSIRSEAPCDAIIQATIADQGNKKGYIDNWSSDGFLRWAHALGFIEYINKSDSPVITDVGL AYSKSADGSAISKEILIEAISSYPPAIRILTLLEDGQHLTKFDLGKNLGFSGESGFTSLPEGILLDTLAN AMPKDKGEIRNNWEGSSDKYARMIGGWLDKLGLVKQGKKEFIIPTLGKPDNKEPISHAFKITGEGLKVLR RAKGSTKPTRVPVPKRVYWEMLATNLTKEYVRTRRALIEILIKAGSLKIEQIQDNLKKLGFDEVIETIEN DIKGLINTGIPIEIKGRFYQLKDHILQFVTPVTPNRGVTKQLVKSELEKKSLRHKLKYVPHSYIELIAR NSTQDRILEMKVMEFFMKVYGYRGKHLGGSRKPDGAIYTVGSPIDYGVIVDTKAYSGGYNLPIGQADEMQ RYVEENQTRNHINPNEWWKVYPSSVTEFKFLFVSHFKKGNYKAQLTRLNHITNCNGAVLSVEELLIGGEE MIKAGLTTLEVRRKFNNGEINP |
| | colicin | 368 | <gi|221185857|gb|ACM07431.1|colicin E9 immunity protein [Escherichia coli]<br>MELKHSISYTEAEFLQLVTTICNADTSSEELVKVTHFEEMTEMPSSGSDLIYYPKEGDDDSPSGIVNT VKQWRAANGKSGFKQG |

In another preferred embodiment according to the method of the present invention, the peptidic linker that can link said catalytic domain to the core TALE scaffold according to the method of the present invention can be selected from the group consisting of NFS1, NFS2, CFS1, RM2, BQY, QGPSG (SEQ ID NO:103), LGPDGRKA (SEQ ID NO:104), 1a8h_1, 1dnpA_1, 1d8cA_2, 1ckqA_3, 1sbp_1, 1ev7A_1, 1alo_3, 1amf_1, 1adjA_3, 1fcdC_1, 1al3_2, 1g3p_1, 1acc_3, 1ahjB_1, 1acc_1, 1af7_1, 1heiA_1, 1bia_2, 1igtB_1, 1nfkA_1, 1au7A_1, 1bpoB_1, 1b0pA_2, 1c05A_2, 1gcb_1, 1bt3A_1, 1b3oB_2, 16vpA_6, 1dhx_1, 1b8aA_1 and 1qu6A_1, as listed in Table 3 (SEQ ID NO: 67 to SEQ ID NO: 104 and SEQ ID NO: 372 to SEQ ID NO: 415). In a more preferred embodiment, the peptidic linker that can link said catalytic domain to the core TALE scaffold according to the method of the present invention can be selected from the group consisting of NFS1 (SEQ ID NO: 98), NFS2 (SEQ ID NO: 99) and CFS1 (SEQ ID NO: 100). In the scope of the present invention is also encompassed the case where a peptidic linker is not needed to fuse a catalytical domain to the TALE scaffold in order to obtain a cTALEN according to the present invention.

TABLE 3

List of peptidic linkers that can be used in compact TALENs or enhanced compact TALENs.

| Name (PDB) | Amino Acids | Size | Length | Sequence | SEQ ID NO |
| --- | --- | --- | --- | --- | --- |
| 1a8h_1 | 285-287 | 3 | 6,636 | NVG | 67 |
| 1dnpA-1 | 130-133 | 4 | 7,422 | DSVI | 68 |
| 1d8cA_2 | 260-263 | 4 | 8,782 | IVEA | 69 |
| 1ckqA_3 | 169-172 | 4 | 9.91 | LEGS | 70 |
| 1sbp_1 | 93-96 | 4 | 10,718 | YTST | 71 |
| 1ev7A_1 | 169-173 | 5 | 11,461 | LQENL | 72 |
| 1alo_3 | 360-364 | 5 | 12,051 | VGRQP | 73 |
| 1amf_1 | 81-85 | 5 | 13,501 | LGNSL | 74 |
| 1adjA_3 | 323-328 | 6 | 14,835 | LPEEKG | 75 |
| 1fcdC_1 | 76-81 | 6 | 14,887 | QTYQPA | 76 |
| 1al3_2 | 265-270 | 6 | 15,485 | FSHSTT | 77 |
| 1g3p_1 | 99-105 | 7 | 17.903 | GYTYINP | 78 |
| 1acc_3 | 216-222 | 7 | 19.729 | LTKYKSS | 79 |
| 1ahjB_1 | 106-113 | 8 | 17.435 | SRPSESEG | 80 |
| 1acc_1 | 154-161 | 8 | 18.776 | PELKQKSS | 81 |
| 1af7_1 | 89-96 | 8 | 22.502 | LTTNLTAF | 82 |
| 1heiA_1 | 322-330 | 9 | 13.534 | TATPPGSVT | 83 |
| 1bia_2 | 268-276 | 9 | 16.089 | LDNFINRPV | 84 |
| 1igtB_1 | 111-119 | 9 | 19.737 | VSSAKTTAP | 85 |
| 1nfkA_1 | 239-248 | 10 | 13.228 | DSKAPNASNL | 86 |
| 1au7A_1 | 103-112 | 10 | 20.486 | KRRTTISIAA | 87 |
| 1bpoB_1 | 138-148 | 11 | 21.645 | PVKMFDRHSSL | 88 |
| 1b0pA_2 | 625-635 | 11 | 26.462 | APAETKAEPMT | 89 |
| 1c05A_2 | 135-148 | 14 | 23.819 | YTRLPERSELPAEI | 90 |
| 1gcb_1 | 57-70 | 14 | 27.39 | VSTDSTPVTNQKSS | 91 |
| 1bt3A_1 | 38-51 | 14 | 28.818 | YKLPAVTTMKVRPA | 92 |
| 1b3oB_2 | 222-236 | 15 | 20.054 | IARTDLKKNRDYPLA | 93 |
| 16vpA_6 | 312-332 | 21 | 23.713 | TEEPGAPLTTPPTLHGNQARA | 94 |
| 1dhx_1 | 81-101 | 21 | 42.703 | ARFTLAVGDNRVLDMASTYFD | 95 |
| 1b8aA_1 | 95-120 | 26 | 31.305 | IVVLNRAETPLPLDPTGKVKAELDTR | 96 |

TABLE 3-continued

List of peptidic linkers that can be used in compact TALENs or enhanced compact TALENs.

| Name (PDB) | Amino Acids | Size | Length | Sequence | SEQ ID NO |
|---|---|---|---|---|---|
| 1qu6A_1 | 79-106 | 28 | 51.301 | ILNKEKKAVSPLLLTTTNSSEGLSMGNY | 97 |
| NFS1 | — | 20 | — | GSDITKSKISEKMKGQGPSG | 98 |
| NFS2 | — | 23 | — | GSDITKSKISEKMKGLGPDGRKA | 99 |
| CFS1 | — | 10 | — | SLTKSKISGS | 100 |
| RM2 | — | 32 | — | AAGGSALTAGALSLTAGALSLTAGALSGGGGS | 101 |
| BQY | — | 25 | — | AAGASSVSASGHIAPLSLPSSPPSVGS | 102 |
| QGPSG | — | 5 | — | QGPSG | 103 |
| LGPDGRKA | — | 8 | — | LGPDGRKA | 104 |
| TAL1 | — | 15 | — | SGGSGSNVGSGSGSG | 372 |
| TAL2 | — | 20 | — | SGGSGSLTTNLTAFSGSGSG | 373 |
| TAL3 | — | 22 | — | SGGSGSKRRTTTISIAASGSGSG | 374 |
| TAL4 | — | 17 | — | SGGSGSVGRQPSGSGSG | 375 |
| TAL5 | — | 26 | — | SGGSGSYTRLPERSELPAEISGSGSG | 376 |
| TAL6 | — | 38 | — | SGGSGSIVVLNRAETPLPLDPTGKVKAELDTRSGSGSG | 377 |
| TAL7 | — | 21 | — | SGGSGSTATPPGSVTSGSGSG | 378 |
| TAL8 | — | 21 | — | SGGSGSLDNFINRPVSGSGSG | 379 |
| TAL9 | — | 21 | — | SGGSGSVSSAKTTAPSGSGSG | 380 |
| TAL10 | — | 22 | — | SGGSGSDSKAPNASNLSGSGSG | 381 |
| TAL11 | — | 23 | — | SGGSGSPVKMFDRHSSLSGSGSG | 382 |
| TAL12 | — | 23 | — | SGGSGSAPAETKAEPMTSGSGSG | 383 |
| TAL13 | — | 26 | — | SGGSGSVSTDSTPVTNQKSSSGSGSG | 384 |
| TAL14 | — | 16 | — | SGGSGSDSVISGSGSG | 385 |
| TAL15 | — | 33 | — | SGGSGSARFTLAVGDNRVLDMASTYFDSGSGSG | 386 |
| TAL16 | — | 17 | — | SGGSGSLQENLSGSGSG | 387 |
| TAL17 | — | 19 | — | SGGSGSGYTYINPSGSGSG | 388 |
| TAL18 | — | 26 | — | SGGSGSYKLPAVTTMKVRPASGSGSG | 389 |
| TAL19 | — | 16 | — | SGGSGSLEGSSGSGSG | 390 |
| TAL20 | — | 16 | — | SGGSGSIVEASGSGSG | 391 |
| TAL21 | — | 18 | — | SGGSGSQTYQPASGSGSG | 392 |
| TAL22 | — | 27 | — | SGGSGSIARTDLKKNRDYPLASGSGSG | 393 |
| TAL23 | — | 18 | — | SGGSGSLPEEKGSGSGSG | 394 |
| TAL24 | — | 16 | — | SGGSGSYTSTSGSGSG | 395 |
| TAL25 | — | 20 | — | SGGSGSSRPSESEGSGSGSG | 396 |
| TAL26 | — | 17 | — | SGGSGSLGNSLSGSGSG | 397 |
| TAL27 | — | 19 | — | SGGSGSLTKYKSSSGSGSG | 398 |
| TAL28 | — | 33 | — | SGGSGSTEEPGAPLTTPPTLHGNQARASGSGSG | 399 |
| TAL29 | — | 18 | — | SGGSGSFSHSTTSGSGSG | 400 |

TABLE 3-continued

List of peptidic linkers that can be used in compact TALENs or enhanced compact TALENs.

| Name (PDB) | Amino Acids | Size | Length | Sequence | SEQ ID NO |
|---|---|---|---|---|---|
| TAL30 | — | 20 | — | SGGSGSPELKQKSSSGSGSG | 401 |
| TAL31 | — | 40 | — | SGGSGSILNKEKKAVSPLLLTTTNSSEGLSMGNYSGSGSG | 402 |
| TAL32 | — | 31 | — | ELAEFHARYADLLLRDLRERPVSLVRGPDSG | 403 |
| TAL33 | — | 31 | — | ELAEFHARPDPLLLRDLRERPVSLVRGLGSG | 404 |
| TAL34 | — | 26 | — | ELAEFHARYADLLLRDLRERSGSGSG | 405 |
| TAL35 | — | 31 | — | DIFDYYAGVAEVMLGHIAGRPATRKRWPNSG | 406 |
| TAL36 | — | 31 | — | DIFDYYAGPDPVMLGHIAGRPATRKRWLGSG | 407 |
| TAL37 | — | 26 | — | DIFDYYAGVAEVMLGHIAGRSGSGSG | 408 |
| Linker A | | 37 | | SIVAQLSRPDPALVSFQKLKLACLGGRPALDAVKKGL | 409 |
| Linker B | | 37 | | SIVAQLSRPDPAAVSAQKAKAACLGGRPALDAVKKGL | 410 |
| Linker C | | 37 | | SIVAQLSRPDPAVVTFHKLKLACLGGRPALDAVKKGL | 411 |
| Linker D | | 44 | | SIVAQLSRPDPAQSLAQELSLNESQIKIACLGGRPALDAVKKGL | 412 |
| Linker F | | 40 | | SIVAQLSRPDPALQLPPLERLTLDACLGGRPALDAVKKGL | 413 |
| Linker F | | 38 | | SIVAQLSRPDPAIHKKFSSIQMACLGGRPALDAVKKGL | 414 |
| Linker G | | 40 | | SIVAQLSRPDPAAAAATNDHAVAAACLGGRPALDAVKKGL | 415 |

Table 3: List of Peptidic Linkers that can be Used in Compact TALENs or Enhanced Compact TALENs.

Depending from its structural composition [type of core TALE scaffold, type of catalytic domain(s) with associated enzymatic activities and eventually type of linker(s)], a compact TALEN according to the present invention can comprise different levels of separate enzymatic activities able to differently process DNA, resulting in a global DNA processing efficiency for said compact TALEN, each one of said different enzymatic activities having their own DNA processing efficiency.

In another preferred embodiment, the method according to the present invention further comprises the steps of:
(i) Engineering at least one enhancer domain;
(ii) Optionally determining or engineering one peptide linker to fuse said enhancer domain to one part of said compact TALEN entity;
thereby obtaining a compact TALEN entity with enhanced DNA processing efficiency nearby a single double-stranded DNA target sequence of interest, i.e an enhanced compact TALEN.

In other words, according to the method of the present invention said unique compact TALEN monomer further comprises:
(i) At least one enhancer domain;
(ii) Optionally one peptide linker to fuse said enhancer domain to one part of said unique compact TALEN monomer active entity.

In another more preferred embodiment, said enhancer domain is fused to the N-terminus of the core TALE scaffold part of said compact TALEN entity. In another more preferred embodiment, said enhancer domain is fused to C-terminus of the core TALE scaffold part of said compact TALEN entity. In another more preferred embodiment, said enhancer domain is fused to the catalytic domain part of said compact TALEN entity. In another more preferred embodiment, said enhancer domain is fused between the N-terminus of the core TALE scaffold part and the catalytic part of said compact TALEN entity. In another more preferred embodiment, said enhancer domain is fused between the C-terminus of the core TALE scaffold part and the catalytic part of said compact TALEN entity. In the scope of the present invention, it can be envisioned to insert said catalytic domain and/or enhancer domain between two parts of the engineered core TALE scaffold according to the invention, each part comprising one set of RVDs. In this last case, the number of RVDs for each engineered core TALE scaffold can be the same or not. In other words, it can be envisioned to split said core TALE scaffold of the present invention to insert one catalytic domain and/or one enhancer domain between the resulting two parts of said engineered core TALE scaffold.

In another preferred embodiment, said enhancer domain is catalytically active or not, providing functional and/or structural support to said compact TALEN entity. In a more preferred embodiment, said enhancer domain consists of a protein domain selected from the group consisting of MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDIA, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E. coli* ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367, a functional mutant, a variant or a derivative thereof. In another more preferred embodiment, said enhancer domain consists of a catalytically active derivative of the protein domains listed above and in Table 2, providing functional and/or structural support to said compact TALEN entity. In another preferred embodiment, said enhancer domain consists of a catalytically inactive derivative of the protein domains listed above and in Table 2, providing structural support to said compact TALEN entity. In another preferred embodiment, said enhancer domain is selected from the group consisting of I-TevI (SEQ ID NO: 20), ColE7 (SEQ ID NO: 11) and NucA (SEQ ID NO: 26).

In a more preferred embodiment, said enhanced compact TALEN according to the method of the present invention can comprise a second enhancer domain. In this embodiment, said second enhancer domain can have the same characteristics than the first enhancer domain. In a more preferred embodiment, said second enhancer domain provides structural support to enhanced compactTALEN entity. In another more preferred embodiment, said second enhancer domain provides functional support to enhanced compact TALEN entity. In a more preferred embodiment, said second enhancer domain provides structural and functional support to the enhanced compact TALEN entity. In a more preferred embodiment, said enhanced compact TALEN entity comprises one catalytic domain and one enhancer domain. In another more preferred embodiment said enhanced compact TALEN entity comprises one catalytic domain and two enhancer domains. In another more preferred embodiment said enhanced compact TALEN entity comprises two catalytic domains and one enhancer domains. In another more preferred embodiment said enhanced compact TALEN entity comprises two catalytic domains and two enhancer domains.

In a more preferred embodiment, said second enhancer domain consists of a protein domain derived from a protein selected from the group consisting of MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E. coli* ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367, a functional mutant, a variant or a derivative thereof. In another more preferred embodiment, said second enhancer domain consists of a catalytically active derivative of the protein domains listed above and in Table 2, providing functional and/or structural support to said enhanced compact TALEN entity. In another preferred embodiment, said second enhancer domain consists of a catalytically inactive derivative of the protein domains listed above and in Table 2, providing structural support to said enhanced compact TALEN entity.

In another more preferred embodiment, any combinations of catalytic and/or enhancer domains listed above, as non-limiting examples, can be envisioned to be fused to said core TALE scaffold providing structural and/or functional support to said compact TALEN entity. More preferably, combinations of catalytic domains selected from the group of TevI (SEQ ID NO: 20), ColE7 (SEQ ID NO: 11) and NucA (SEQ ID NO: 26) can be envisioned. Optionally, FokI (SEQ ID NO: 368) can be used in combination with another catalytic domain according to the list of Table 2. Such combinations of catalytic and/or enhancer domains can be envisioned regarding the envisioned applications for using the method of the present invention.

Depending from its structural composition [type of core TALE scaffold, type of catalytic domain(s) with associated enzymatic activities, eventually type of linker(s) and type of enhancer(s) domains], an enhanced compact TALEN according to the present invention can present different levels of separate enzymatic activities able to differently process DNA, resulting in a global DNA processing efficiency for said enhanced compact TALEN, each one of said different enzymatic activities having their own DNA processing efficiency.

In this preferred embodiment, the DNA processing efficiency of the compact TALEN entity according to the method of the present invention can be enhanced by the engineering of at least one enhancer domain and one peptidic linker thereby obtaining a compact TALEN entity with enhanced DNA processing activity nearby a single double-stranded DNA target sequence of interest, i.e a enhanced compact TALEN according to the present invention.

Depending on its structural composition, the global DNA processing efficiency that is enhanced in said enhanced compact TALEN according to the present invention, can have a dominant enzymatic activity selected from the group consisting of a nuclease activity, a polymerase activity, a kinase activity, a phosphatase activity; a methylase activity, a topoisomerase activity, an integrase activity, a transposase activity or a ligase activity as non-limiting examples. In a more preferred embodiment, the global DNA processing efficiencythat is enhanced in said enhanced compact TALEN according to the present invention is a combination of different enzymatic activities selected from the group consisting of a nuclease activity, a polymerase activity, a kinase activity, a phosphatase activity, a methylase activity, a topoisomerase activity, an integrase activity, a transposase activity or a ligase activity as non-limiting examples. In a more preferred embodiment, the global DNA processing efficiency that is enhanced in said enhanced compact TALEN according to the present invention is one of its different enzymatic activities selected from the group consisting of a nuclease activity, a polymerase activity, a kinase activity, a phosphatase activity, a methylase activity, a topoisomerase activity, an integrase activity, a transposase activity or a ligase activity as non-limiting examples. In this case, the global DNA processing efficiency is equivalent to one DNA processing activity amongst the enzymatic activities mentioned above. In another more preferred embodiment, said DNA processing activity of the compact TALEN entity which is enhanced by the enhancer is a cleavase activity or a nickase activity or a combination of both a cleavase activity and a nickase activity.

Enhancement of DNA processing efficiency of a compact TALEN entity according to the present invention can be a consequence of a structural support by at least one enhancer domain. In a preferred embodiment, said structural support enhances the binding of a compact TALEN entity according to the invention for said DNA target sequence compared to the binding of a starting compact TALEN entity for the same DNA target sequence, thereby indirectly assisting the catalytic domain(s) to obtain a compact TALEN entity with enhanced DNA processing activity. In another preferred embodiment, said structural support enhances the existing catalytical activity of a compact TALEN entity for a DNA target sequence compared to the binding of a starting compact TALEN entity for the same DNA target sequence to obtain a compact TALEN entity with enhanced DNA processing activity.

In another preferred embodiment, said enhancer according to the method of the present invention both enhances the binding of the compact TALEN entity for said DNA target sequence and the catalytic activity of the catalytic domain(s) to obtain a compact TALEN entity with enhanced DNA processing activity. All these non-limiting examples lead to a compact TALEN entity with enhanced DNA processing efficiency for a DNA target sequence at a genomic locus of interest, i.e an enhanced compact TALEN according to the present invention.

Enhancement of DNA processing efficiency of a compact TALEN entity according to the present invention, compared to a starting compact TALEN entity, can also be a consequence of a functional support by at least one enhancer domain. In a preferred embodiment, said functional support can be the consequence of the hydrolysis of additional phosphodiester bonds. In a more preferred embodiment, said functional support can be the hydrolysis of additional phosphodiester bonds by a protein domain derived from a nuclease. In an embodiment, said functional support can be the hydrolysis of additional phosphodiester bonds by a protein domain derived from an endonuclease. In a more preferred embodiment, said functional support can be the hydrolysis of additional phosphodiester bonds by a protein domain derived from a cleavase. In another more preferred embodiment, said functional support can be the hydrolysis of additional phosphodiester bonds by a protein domain derived from a nickase. In a more preferred embodiment, said functional support can be the hydrolysis of additional phosphodiester bonds by a protein domain derived from an exonuclease.

In genome engineering experiments, the efficiency of rare-cutting endonuclease, e.g. their ability to induce a desired event (Homologous gene targeting, targeted mutagenesis, sequence removal or excision) at a locus, depends on several parameters, including the specific activity of the nuclease, probably the accessibility of the target, and the efficacy and outcome of the repair pathway(s) resulting in the desired event (homologous repair for gene targeting, NHEJ pathways for targeted mutagenesis).

Cleavage by peptidic rare cutting endonucleases usually generates cohesive ends, with 3' overhangs for LAGLIDADG meganucleases (Chevalier and Stoddard 2001) and 5' overhangs for Zinc Finger Nucleases (Smith, Bibikova et al. 2000). These ends, which result from hydrolysis of phosphodiester bonds, can be re-ligated in vivo by NHEJ in a seamless way (i.e a scarless re-ligation). The restoration of a cleavable target sequence allows for a new cleavage event by the same endonuclease, and thus, a series of futile cycles of cleavage and re-ligation events can take place. Indirect evidences have shown that even in the yeast *Saccharomyces cerevisiae*, such cycles could take place upon continuous cleavage by the HO endonuclease (Lee, Paques et al. 1999). In mammalian cells, several experiment have shown that perfect re-ligation of compatible cohesive ends resulting from two independent but close I-SceI-induced DSBs is an efficient process (Guirouilh-Barbat, Huck et al. 2004; Guirouilh-Barbat, Rass et al. 2007; Bennardo, Cheng et al. 2008; Bennardo, Gunn et al. 2009). Absence of the Ku DNA repair protein does not significantly affect the overall frequency of NHEJ events rejoining the ends from the two DSBs; however it very strongly enhances the contribution of imprecise NHEJ to the repair process in CHO immortalized cells and mouse ES cells (Guirouilh-Barbat, Huck et al. 2004; Guirouilh-Barbat, Rass et al. 2007; Bennardo, Cheng et al. 2008). Furthermore, the absence of Ku stimulates I-SceI-induced events such as imprecise NHEJ (Bennardo, Cheng et al. 2008), single-strand annealing (Bennardo, Cheng et al. 2008) and gene conversion (Pierce, Hu et al. 2001; Bennardo, Cheng et al. 2008) in mouse ES cells. Similar observations shave been made with cells deficient for the XRCC4 repair protein (Pierce, Hu et al. 2001; Guirouilh-Barbat, Rass et al. 2007; Bennardo, Gunn et al. 2009) (although XRCC4 deficiency affects the overall level of NHEJ in CHO cells (Guirouilh-Barbat, Rass et al. 2007)) or for DNA-PK (Pierce, Hu et al. 2001). In contrast, knockdown of CtIP has been shown to suppresses "alt-NHEJ" (a Ku- and XRCC4-independent form of NHEJ more prone to result in imprecise NHEJ), single-strand annealing and gene conversion, while not affecting the overall level of rejoining of two compatible ends generated by I-SceI (Bennardo, Cheng et al. 2008). Thus, competition between different DSB repair pathways can affect the spectrum or repair events resulting from a nuclease-induced DSB.

In addition, DSB resection is important for certain DSB pathways. Extensive DSB resection, resulting in the generation of large single stranded regions (a few hundred nucleotides at least), has been shown in yeast to initiate single strand annealing (Sugawara and Haber 1992) and strand invasion, the ATP-dependant step that initiates many homologous recombination events of DNA duplex invasion by an homologous strand that (White and Haber 1990; Sun, Treco et al. 1991) (for a review of mechanisms, see (Paques and Haber 1999)). In eukaryotic cells DSB resection depends on several proteins including BLM/Sgs1 and DNA2, EXOI, and the MRN complex (Mre11, Rad50, Nbs1/Xrs2) and is thought to result from different pathways. MRN is involved in a small scale resection process, while two redundant pathways depending on BLM and DNA2 on one hand, and on EXOI on another hand, would be involved in extensive resection (Mimitou and Symington 2008; Nimonkar, Genschel et al. 2011). In addition, processing ends involving a damaged nucleotide (resulting from chemical cleavage or from a bulk adduct), requires the CtIP/Sae2 protein together with RMN (Sartori, Lukas et al. 2007; Buis, Wu et al. 2008; Hartsuiker, Mizuno et al. 2009). Overexpression of the Trex2 exonuclease was shown to strongly stimulate imperfect NHEJ associated with loss of only a few base pairs (Bennardo, Gunn et al. 2009), while it inhibited various kinds of DNA repair events between distant sequences (such as Single-strand annealing, NHEJ between ends from different breaks, or NHEJ repair of a single DSB involving remote micro-homologies). In the same study, it was suggested that Trex2 did resect the 3' overhangs let by I-SceI in a non processive way. Thus, the type of stimulated pathway could in turn depend on the type of resection (length of resection, single strand vs. double strand, resection of 5' strand vs. 3' strand).

Thus, the efficiency of a compact TALEN, e.g. it ability to produce a desired event such as targeted mutagenesis or homologous gene targeting (see definition for full definition of "efficiency of compact TALEN"), can be enhanced by an enhancement or modification of its global DNA processing efficiency (see definition for full definition of "global DNA processing efficiency"), e.g. the global resultant or the overall result of different separate enzymatic activities that said compact TALEN.

In a preferred embodiment, enhancement of global DNA processing efficiency of a compact TALEN entity according to the present invention, compared to a starting compact TALEN entity, can be the hydrolysis of additional phosphodiester bonds at the cleavage site.

Said hydrolysis of additional phosphodiester bonds at the cleavage site by said at least one enhancer according to the invention can lead to different types of DSB resection affecting at said DSB cleavage site, one single DNA strand or both DNA strands, affecting either 5' overhangs ends, either 3' overhangs ends, or both ends and depending on the length of said resection. Thus, adding new nickase or cleavase activities to the existing cleavase activity of a compact TALEN entity can enhance the efficiency of the resulting enhanced compact TALEN according to the invention, at a genomic locus of interest (FIG. 8B-8E). As a non-limiting example, addition of two nickase activities on opposite strands (FIG. 8D) or of a new cleavase activity generating a second DSB (FIG. 8E) can result in a double-strand gap. As a consequence, perfect religation is no longer possible, and one or several alternative repair outcomes such as imprecise NHEJ, Homologous Recombination or SSA for instance, can be stimulated. As another non-limiting example, the addition of a single nickase activity can result in a single strand gap, and suppress the cohesiveness of the ends, which can also enhance the efficiency of the resulting enhanced compact TALEN at a genomic locus of interest, according to the invention, via stimulation of one or several alternative repair outcomes mentioned above.

In this aspect of the present invention, enhancement of DNA processing efficiency of a compact TALEN refers to the increase in the detected level of said DNA processing efficiency, against a target DNA sequence, of a enhanced compact TALEN in comparison to the activity of a first compact TALEN against the same target DNA sequence. Said first compact TALEN can be a starting compact TALEN, or a compact TALEN that has already been engineered or an enhanced compact TALEN according to the present invention. Several rounds of enhancement can be envisioned from a starting compact TALEN or from a starting enhanced compact TALEN.

In this aspect of the method of the present invention, enhancement of the DNA processing efficiency of the compact TALEN entity (or enhanced compact TALEN) refers to the increase in the detected level of said DNA processing efficiency against a target DNA sequence of interest or nearby said DNA sequence of interest in comparison to the efficiency of a first compact TALEN or starting compact TALEN against or nearby the same target DNA sequence. In this case, the starting compact TALEN is taken as the reference scaffold to measure the DNA processing efficiency. Said enhanced compact TALEN is an engineered compact TALEN comprising an enhancer domain according to this aspect of the invention. Said enhanced compact TALEN can also be taken as a reference scaffold for further enhancement of said DNA processing efficiency. As a non-limiting example, said DNA processing efficiency can result from a cleavage-induced recombination generated by said enhanced compact TALEN. In this case, said level of cleavage-induced recombination can be determined, for instance, by a cell-based recombination assay as described in the International PCT Application WO 2004/067736. Importantly, enhancement of efficacy in cells (enhanced generation of targeted mutagenesis or targeted recombination) can be, but is not necessarily associated with an enhancement of the cleavage activity that could be detected in certain in vitro assays. For example, additional phosphodiesterase activities as described in FIG. 8 could barely affect the cleavage profile, as detected by in vitro cleavage and separation of the cleavage products on an electrophoresis gel. However, as explained above, and in the legend of FIG. 8, the DSB ends generated in this way could be more prone to induce detectable genomic rearrangements such as targeted mutagenesis (by imprecise NHEJ) or homologous recombination. Said enhancement in cleavage-induced recombination of said enhanced compact TALEN is at least a 5% enhancement compared to the starting scaffold or starting compact TALEN, more preferably at least a 10% enhancement, again more preferably at least a 15% enhancement, again more preferably at least a 20% enhancement, again more preferably at least a 25% enhancement, again more preferably a 50% enhancement, again more preferably an enhancement greater than 50%, resulting in an enhancement of DNA processing efficiency of said enhanced compact TALEN of at least 5% compared to the starting scaffold or starting compact TALEN, more preferably at least a 10% enhancement, again more preferably at least a 15% enhancement, again more preferably at least a 20% enhancement, again more preferably at least a 25% enhancement, again more preferably a 50% enhancement, again more preferably a enhancement greater than 50%.

In another preferred embodiment according to the method of the present invention, the peptidic linker that can link said enhancer domain to one part of said compact TALEN entity according to the method of the present invention can be selected from the group consisting of NFS1, NFS2, CFS1, RM2, BQY, QGPSG NO:103), LGPDGRKA (SEQ ID NO:104), 1a8h_1, 1dnpA_1, 1d8cA_2, 1ckqA_3, 1sbp_1, 1ev7A_1, 1alo_3, 1amf_1, 1adjA_3, 1fcdC_1, 1al3_2, 1g3p_1, 1acc_3, 1ahjB_1, 1acc_1, 1af7_1, 1heiA_1, 1bia_2, 1igtB_1, 1nfkA_1, 1au7A_1, 1bpoB_1, 1b0pA_2, 1c05A_2, 1gcb_1, 1bt3A_1, 1b3oB_2, 16vpA_6, 1dhx_1, 1b8aA_1 and 1qu6A_1, as listed in Table 3 (SEQ ID NO: 67 to SEQ ID NO: 104 and SEQ ID NO: 372 to SEQ ID NO: 415). In a more preferred embodiment, the peptidic linker that can said enhancer domain to one part of said compact TALEN entity according to the method of the present invention can be selected from the group consisting of NFS1 (SEQ ID NO: 98), NFS2 (SEQ ID NO: 99) and CFS1 (SEQ ID NO: 100). In the scope of the present invention is also encompassed the case where a peptidic linker is not needed to fuse one enhancer domain to one part of said compact TALEN entity in order to obtain a enhanced compact TALEN according to the present invention.

Depending from its structural composition [type of core TALE scaffold, type of catalytic domain(s) with associated enzymatic activities, type of enhancers and eventually type of linker(s)], a compact TALEN or an enhanced compact TALEN according to the present invention can comprise different levels of separate enzymatic activities able to differently process DNA as mentioned above. By adding new enzymatic activities to said compact TALEN or said enhanced compact TALEN or enhancing the DNA processing efficiency of one or several of its constitutive enzymatic activities, one can enhance the global DNA processing efficiency of one compact TALEN or enhanced compact TALEN in comparison to a starting compact TALEN or enhanced compact TALEN.

According to the present invention, compact TALENs are designed to alleviate the need for multiple independent protein moieties when targeting a DNA processing event. Importantly, the requisite "spacer" region and dual target sites essential for the function of current TALENs are unnecessary. As each end of the core TALE scaffold is amenable to fusion, the order (N- vs. C-terminal) of addition of the catalytic and enhancement domains can vary with the application. In addition, since the catalytic domain does not require specific DNA contacts, there are no restrictions on regions surrounding the core TALE scaffold, as non-limiting examples depicted in FIG. 5: (A) N-terminal fusion construct to promote Homologous recombination induced by a cleavase domain or by a nickase domain. (B) C-terminal fusion construct with properties as in (A). (C) The attachment of two catalytic domains to both ends of the core TALE scaffold allows for dual cleavage with enhancement in NHEJ. Fusion junctions (N- vs. C-terminal) and linker designs can vary with the application.

According to the present invention, compact TALENs can be enhanced through the addition of a domain to promote existing or alternate activities as non-limiting examples depicted in FIG. 6: (A) A standard compact TALEN with an enhancer domain fused to the C-terminus of its core TALE scaffold part. (B) The enhancer domain is fused to the compact TALEN via the N-terminus of its catalytic domain part. Such a configuration can be used to assist and/or anchor the catalytic domain part near the DNA to increase DNA processing activity. (C) The enhancer domain is sandwiched between the catalytic domain part and the core TALE scaffold part. The enhancer domain can promote communication between the flanking domains (i.e. to assist in catalysis and/or DNA binding) or can be used to overcome the requisite T nucleotide at position −1 of all TALE-based targets. (D) The enhancer domain is used to functionally replace the engineered core TALE scaffold N-terminal region. (E) The enhancer domain is used to functionally replace the engineered core TALE scaffold C-terminal region. Fusion junctions (N- vs. C-terminal) and linker designs can vary with the application.

According to the present invention, the nature of the catalytic domain(s) comprised in the compact TALEN and the enhanced compact TALEN is application dependent. As a non-limiting example, a nickase domain should allow for a higher HR/NHEJ ratio than a cleavase domain, thereby being more agreeable for therapeutic applications (McConnell Smith, Takeuchi et al. 2009; Metzger, McConnell-Smith et al. 2011). For example, the coupling of a cleavase domain on one side with a nickase domain on the other could result in excision of a single-strand of DNA spanning the binding region of a compact TALEN. The targeted generation of extended single-strand overhangs could be applied in applications that target DNA repair mechanisms. For targeted gene inactivation, the use of two cleavase domains is then preferred. In another preferred embodiment, the use of two nickase domains can be favored. Furthermore, the invention relates to a method for generating several distinct types of compact TALENs that can be applied to applications ranging from targeted DNA cleavage to targeted gene regulation.

In another aspect, the present invention relates to a compact TALEN comprising:
  (i) One core TALE scaffold comprising different sets of Repeat Variable Dipeptide regions (RVDs) to change DNA binding specificity and target a specific single double-stranded DNA target sequence of interest, onto which a selection of catalytic domains can be attached to effect DNA processing;
  (ii) At least one catalytic domain wherein said catalytic domain is capable of processing DNA nearby said single double-stranded DNA target sequence of interest when fused to said engineered core TALE scaffold from (i);
  (iii) Optionally one peptidic linker to fuse said catalytic domain from (ii) to said engineered core TALE scaffold from (i) when needed;
such that said compact TALEN does not require dimerization to target a specific single double-stranded DNA target sequence of interest and process DNA nearby said single double-stranded DNA target sequence of interest. In other words, the compact TALEN according to the present invention is an active entity unit able, by itself, to target only one specific single double-stranded DNA target sequence of interest through one DNA binding domain and to process DNA nearby said single double-stranded DNA target sequence of interest.

The present invention relates to a compact TALEN monomer comprising:
  (i) One core TALE scaffold comprising Repeat Variable Dipeptide regions (RVDs) having DNA binding specificity onto a specific-double-stranded DNA target sequence of interest;
  (ii) At least one catalytic domain wherein said catalytic domain is capable of processing DNA a few base pairs away from said double-stranded DNA target sequence of interest when fused to the C or N terminal of said core TALE scaffold from (i);
  (iii) Optionally one peptidic linker to fuse said catalytic domain from (ii) to said engineered core TALE scaffold from (i) when needed;
wherein said compact TALEN monomer is assembled to bind said target DNA sequence and process double-stranded DNA without requiring dimerization.

In another embodiment, said engineered core TALE scaffold of the compact TALEN according to the present invention comprises an additional N-terminal domain resulting in an engineered core TALE scaffold sequentially comprising a N-terminal domain and different sets of Repeat Variable Dipeptide regions (RVDs) to change DNA binding specificity and target a specific single double-stranded DNA target sequence of interest, onto which a selection of catalytic domains can be attached to effect DNA processing.

In another embodiment, said engineered core TALE scaffold of the compact TALEN according to the present invention comprises an additional C-terminal domain resulting in an engineered core TALE scaffold sequentially comprising different sets of Repeat Variable Dipeptide regions (RVDs) to change DNA binding specificity and target a specific single double-stranded DNA target sequence of interest and a C-terminal domain, onto which a selection of catalytic domains can be attached to effect DNA processing. In another embodiment, said engineered core TALE-scaffold of the compact TALEN according to the present invention comprises additional N-terminus and a C-terminal domains resulting in an engineered core TALE scaffold sequentially comprising a N-terminal domain, different sets of Repeat Variable Dipeptide regions (RVDs) to change DNA binding specificity and target a specific single double-stranded DNA target sequence of interest and a C-terminal domain, onto which a selection of catalytic domains can be attached to effect DNA processing.

In another embodiment, said engineered core TALE-scaffold according to the present invention comprises the protein sequences selected from the group consisting of ST1 (SEQ ID NO: 134) and ST2 (SEQ ID NO: 135). In another embodiment, said engineered core TALE scaffold comprises a protein sequence having at least 80%, more preferably 90%, again more preferably 95% amino acid sequence identity with the protein sequences selected from the group consisting of SEQ ID NO: 134 and SEQ ID NO: 135. In another embodiment, said engineered core TALE-scaffold according to the present invention comprises the protein sequences selected from the group consisting of bT1-Avr (SEQ ID NO: 136), bT2-Avr (SEQ ID NO: 137), bT1-Pth (SEQ ID NO: 138) and bT2-Pth (SEQ ID NO: 139). In another embodiment, said engineered TALE-scaffold comprises a protein sequence having at least 80%, more preferably 90%, again more preferably 95% amino acid sequence identity with the protein sequences selected from the group consisting of SEQ ID NO: 136 to SEQ ID NO: 139.

In a preferred embodiment, said additional N-terminus and C-terminal domains of engineered core TALE scaffold are derived from natural TALE. In a more preferred embodiment said additional N-terminus and C-terminal domains of engineered core TALE scaffold are derived from natural TALE selected from the group consisting of AvrBs3, PthXo1, AvrHah1, PthA, Tal1c as non-limiting examples. In another more preferred embodiment, said additional N-terminus and/or said C-terminal domains are truncated forms of respective N-terminus and/or said C-terminal domains of natural TALE like AvrBs3, PthXo1, AvrHah1, PthA, Tal1c as non-limiting examples, from which they are derived. In a more preferred embodiment, said additional N-terminus and C-terminal domains sequences of engineered core TALE scaffold are selected from the group consisting of ST1 SEQ ID NO: 134 and ST2 SEQ ID NO: 135 as respectively exemplified in baseline protein scaffolds bT1-Avr (SEQ ID NO: 136) or bT1-Pth (SEQ ID NO: 138) and bT2-Avr (SEQ ID NO: 137) or bT2-Pth (SEQ ID NO: 139).

In another embodiment, each RVD of said core scaffold is made of 30 to 42 amino acids, more preferably 33 or 34 wherein two critical amino acids located at positions 12 and 13 mediates the recognition of one nucleotide of said nucleic acid target sequence; equivalent two critical amino acids can be located at positions other than 12 and 13 specially in RVDs taller than 33 or 34 amino acids long. Preferably, RVDs associated with recognition of the different nucleotides are HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. More preferably, RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, RVDS associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 can be mutated towards other amino acid residues in order to modulate their specificity towards nucleotides A, T, C and G and in particular to enhance this specificity. By other amino acid residues is intended any of the twenty natural amino acid residues or unnatural amino acids derivatives.

In another embodiment, said core scaffold of the present invention comprises between 8 and 30 RVDs. More preferably, said core scaffold of the present invention comprises between 8 and 20 RVDs; again more preferably 15 RVDs.

In another embodiment, said core scaffold comprises an additional single truncated RVD made of 20 amino acids located at the C-terminus of said set of RVDs, i.e. an additional C-terminal half-RVD. In this case, said core scaffold of the present invention comprises between 8.5 and 30.5 RVDs, "0.5" referring to previously mentioned half-RVD (or terminal RVD, or half-repeat). More preferably, said core scaffold of the present invention comprises between 8.5 and 20.5 RVDs, again more preferably, 15.5 RVDs. In a preferred embodiment, said half-RVD is in a core scaffold context which allows a lack of specificity of said half-RVD toward nucleotides A, C, G, T. In a more preferred embodiment, said half-RVD is absent.

In another embodiment, said core scaffold of the present invention comprises RVDs of different origins. In a preferred embodiment, said core scaffold comprises RVDs originating from different naturally occurring TAL effectors. In another preferred embodiment, internal structure of some RVDs of the core scaffold of the present invention are constituted by structures or sequences originated from different naturally occurring TAL effectors. In another embodiment, said core scaffold of the present invention comprises RVDs-like domains. RVDs-like domains have a sequence different from naturally occurring RVDs but have the same function and/or global structure within said core scaffold of the present invention.

In another embodiment, said additional N-terminal domain of said engineered core TALE scaffold of said compact TALEN according to the present invention is an enhancer domain. In another embodiment, said enhancer domain is selected from the group consisting of Puf RNA binding protein or Ankyrin super-family, as non-limiting examples. In another embodiment, said enhancer domain sequence is selected from the group consisting of protein domains of SEQ ID NO: 4 and SEQ ID NO: 5 as non-limiting examples listed in Table 1, a functional mutant, a variant or a derivative thereof. In another embodiment, said additional C-terminal domain of said engineered core TALE scaffold is an enhancer domain. In another embodiment, said enhancer domain is selected from the group consisting of hydrolase/transferase of *Pseudomonas* Aeuriginosa family, the polymerase domain from the *Mycobacterium tuberculosis* Ligase D family, the initiation factor eIF2 from *Pyrococcus* family, the translation initiation factorAif2 family as non-limiting examples. In another embodiment, said enhancer domain sequence is selected from the group consisting of protein domains of SEQ ID NO: 6 to SEQ ID NO: 9 as non-limiting examples listed in Table 1.

In another preferred embodiment, the catalytic domain that is capable of processing DNA nearby the single double-stranded DNA target sequence of interest, when fused to said engineered core TALE scaffold according to the present invention, is fused to the N-terminus part of said core TALE scaffold. In another preferred embodiment, said catalytic domain is fused to the C-terminus part of said core TALE scaffold. In another preferred embodiment two catalytic domains are fused to both N-terminus part of said core TALE scaffold and C-terminus part of said core TALE scaffold. In a more preferred embodiment, said catalytic domain has an enzymatic activity selected from the group consisting of nuclease activity, polymerase activity, kinase activity, phosphatase activity, methylase activity, topoisomerase activity, integrase activity, transposase activity or ligase activity. In another preferred embodiment, the catalytic domain fused to the core TALE scaffold of the present invention can be a transcription activator or repressor (i.e. a transcription regulator), or a protein that interacts with or modifies other proteins such as histones. Non-limiting examples of DNA processing activities of said compact TALEN of the present invention include, for example, creating or modifying epigenetic regulatory elements, making site-specific insertions, deletions, or repairs in DNA, controlling gene expression, and modifying chromatin structure.

In another more preferred embodiment, said catalytic domain has an endonuclease activity. In another more preferred embodiment, said catalytic domain of the compact TALEN according to the present invention has cleavage activity on said double-stranded DNA according to the method of the present invention. In another more preferred embodiment, said catalytic domain has a nickase activity on said double-stranded DNA according to the method of the present invention. In another more preferred embodiment, said catalytic domain is selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), E. coli ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative thereof. In another preferred embodiment said catalytic domain of the compact TALEN according to the present invention is I-TevI (SEQ ID NO: 20), a functional mutant, a variant or a derivative thereof. In another preferred embodiment, catalytic domain I-TevI (SEQ ID NO: 20), a functional mutant, a variant or a derivative thereof is fused to the N-terminal domain of said core TALE scaffold according to the compact TALEN of the present invention. In another preferred embodiment, said compact TALEN according to the present invention comprises a protein sequence having at least 80%, more preferably 90%, again more preferably 95% amino acid sequence identity with the protein sequences selected from the group of SEQ ID NO: 426-432.

In another preferred embodiment, said catalytic domain of the compact TALEN according to the present invention is ColE7 (SEQ ID NO: 11), a functional mutant, a variant or a derivative thereof. In another preferred embodiment, catalytic domain ColE7 (SEQ. ID NO: 11), a functional mutant, a variant or a derivative thereof is fused to the N-terminal domain of said core TALE scaffold according to the method of the present invention. In another preferred embodiment, catalytic domain ColE7 (SEQ ID NO: 11), a functional mutant, a variant or a derivative thereof is fused to the C-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 435-438.

In another preferred embodiment, said catalytic domain of the compact TALEN according to the present invention is NucA (SEQ ID NO: 26), a functional mutant, a variant or a derivative thereof. In another preferred embodiment, catalytic domain NucA (SEQ ID NO: 26), a functional mutant, a variant or a derivative thereof is fused to the N-terminal domain of said core TALE scaffold according to the method of the present invention. In another preferred embodiment, catalytic domain NucA (SEQ ID NO: 26), a functional mutant, a variant or a derivative thereof is fused to the C-terminal domain of said core TALE scaffold according to the method of the present invention. In another preferred embodiment, said compact TALEN according to the method of the present invention comprises a protein sequence having at least 80%, more preferably 90%, again more preferably 95% amino acid sequence identity with the protein sequences selected from the group of SEQ ID NO: 433-434.

In another preferred embodiment, said catalytic domain is I-CreI (SEQ ID NO: 1), a functional mutant, a variant or a derivative thereof. In another preferred embodiment, catalytic domain I-CreI (SEQ ID NO: 1), a functional mutant, a variant or a derivative thereof is fused to the N-terminal domain of said core TALE scaffold according to the method of the present invention. In another preferred embodiment, catalytic domain I-CreI (SEQ ID NO: 1), a functional mutant, a variant or a derivative thereof is fused to the C-terminal domain of said core TALE scaffold according to the present invention. In another preferred embodiment, said compact TALEN according to the present invention comprises a protein sequence having at least 80%, more preferably 90%, again more preferably 95% amino acid sequence identity with the protein sequences selected from the group of SEQ ID NO: 439-441 and SEQ ID NO: 444-446.

In another embodiment, said catalytic domain is a restriction enzyme such as MmeI, R-HinPII, R.MspI, R.MvaI, Nb.BsrDI, BsrDI A, Nt.BspD6I, ss.BspD6I, R.PleI, MlyI and AlwI as non-limiting examples listed in table 2. In another more preferred embodiment, said catalytic domain has an exonuclease activity. In another more preferred embodiment, any combinations of two catalytic domains selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), E. coli ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative of these protein domains thereof, can be fused to both N-terminus part and C-terminus part of said core TALE scaffold, respectively. For example, I-HmuI catalytic domain can be fused to the N-terminus part of said core TALE scaffold and ColE7 catalytic domain can be fused to the C-terminus part of said core TALE scaffold. In another example, I-TevI catalytic domain can be fused to the N-terminus part of said core TALE scaffold and ColE7 catalytic domain can be fused to the C-terminus part of said core TALE scaffold. Table 14 below gives non-limiting examples of combinations of catalytic domains that can be comprised in the compact TALEN monomer according to the present invention. Optionally, FokI (SEQ ID NO:368) can be used in combination with another catalytic domain according to the list of Table 2.

TABLE 14

Examples of combinations of catalytic domains respectively fused to N and C-terminus part of compact TALEN core scaffolds according to the present invention leading to dual-cleavage TALENs.

| Catalytic domain fused to N-terminus part of core TALE scaffold | Catalytic domain fused to C-terminus part of core TALE scaffold | Dual-cleavage TALENS |
|---|---|---|
| I-TevI | I-TevI | TevI-TevI |
| ColE7 | ColE7 | ColE7-ColE7 |
| NucA | NucA | NucA-NucA |
| I-TevI | ColE7 | TevI-ColE7 |
| I-TevI | NucA | TevI-NucA |
| ColE7 | I-TevI | ColE7-TevI |
| ColE7 | NucA | ColE7-NucA |
| NucA | I-TevI | NucA-TevI |
| NucA | ColE7 | NucA-ColE7 |

In a preferred embodiment according to the present invention, said unique compact TALEN monomer comprises a combination of two catalytic domains respectively fused to the N-terminus part and to the C-terminus part of said core TALE scaffold selected from the group consisting of:
(i) A Nuc A domain (SEQ ID NO: 26) in N-terminus and a Nuc A domain (SEQ ID NO: 26) in C-terminus;
(ii) A ColE7 domain (SEQ ID NO: 11) in N-terminus and a ColE7 domain (SEQ ID NO: 11) in C-terminus;
(iii) A TevI domain (SEQ ID NO: 20) in N-terminus and a ColE7 domain (SEQ ID NO: 11) in C-terminus;
(iv) A TevI domain (SEQ ID NO: 20) in N-terminus and a NucA domain (SEQ ID NO: 26) in C-terminus;
(v) A ColE7 domain (SEQ ID NO: 11) in N-terminus and a NucA domain (SEQ ID NO: 26) in C-terminus;
(vi) A NucA domain (SEQ ID NO: 26) in N-terminus and a ColE7 domain (SEQ ID NO: 11) in C-terminus.

In another preferred embodiment, said compact TALEN according to the present invention comprises a protein sequence having at least 80%, more preferably 90%, again more preferably 95% amino acid sequence identity with the protein sequences selected from the group consisting of SEQ ID NO: 448 and 450.

In another preferred embodiment, said compact TALEN according to the present invention comprises a combination of two catalytic domains respectively fused to the C-terminus part and to the N-terminus part of said core TALE scaffold selected from the group consisting of:

(i) A TevI domain (SEQ ID NO: 20) in N-terminus and a FokI domain (SEQ ID NO: 368) in C-terminus;
(ii) A TevI domain (SEQ ID NO: 20) in N-terminus and a TevI domain (SEQ ID NO: 20) in C-terminus;
(iii) A scTrex2 domain (SEQ ID NO: 451) in N-terminus and a FokI domain (SEQ ID NO: 368) in C-terminus.

In another preferred embodiment, said compact TALEN according to the present invention comprises a protein sequence having at least 80%, more preferably 90%, again more preferably 95% amino acid sequence identity with the protein sequences selected from the group consisting of SEQ ID NO: 447-450 and SEQ ID NO: 452.

In the scope of the present invention, it can be envisioned to insert said catalytic domain and/or said enhancer domain between two parts of the engineered core TALE scaffold according to the invention, each part comprising one set of RVDs. In this last case, the number of RVDs for each part of the engineered core TALE scaffold can be the same or not. In other words, it can be envisioned to split said core TALE scaffold of the present invention to insert one catalytic domain and/or one enhancer domain between the resulting two parts of said engineered core TALE scaffold. In another preferred embodiment, said compact TALEN according to the present invention comprises a protein sequence having at least 80%, more preferably 90%, again more preferably 95% amino acid sequence identity with the protein sequences selected from the group consisting of SEQ ID NO: 453-455.

In other words, the compact TALEN monomer of the present invention comprises a protein sequence having at least 80%, more preferably 90%, again more preferably 95% amino acid sequence identity with the protein sequences selected from the group consisting of SEQ ID NO: 420-450 and 452-455.

In another preferred embodiment according to the method of the present invention, the peptidic linker that can link said catalytic domain to the core TALE scaffold according to the method of the present invention can be selected from the group consisting of NFS1, NFS2, CFS1, RM2, BQY, QGPSG (SEQ ID NO:103), LGPDGRKA (SEQ ID NO:104), 1a8h_1, 1dnpA_1, 1d8cA_2, 1ckqA_3, 1sbp_1, 1ev7A_1, 1alo_3, 1amf_1, 1adjA_3, 1fcdC_1, 1al3_2, 1g3p_1, 1acc_3, 1ahjB_1, 1acc_1, 1af7_1, 1heiA_1, 1bia_2, 1igtB_1, 1nfkA_1, 1au7A_1, 1bpoB_1, 1b0pA_2, 1c05A_2, 1gcb_1, 1bt3A_1, 1b3oB_2, 16vpA_6, 1dhx_1, 1b8aA_1 and 1qu6A_1, as listed in Table 3 (SEQ ID NO: 67 to SEQ ID NO: 104 and SEQ ID NO: 372 to SEQ ID NO: 415). In a more preferred embodiment, the peptidic linker that can link said catalytic domain to the core TALE scaffold according to the method of the present invention can be selected from the group consisting of NFS1 (SEQ ID NO: 98), NFS2 (SEQ ID NO: 99) and CFS1 (SEQ ID NO: 100). In the scope of the present invention is also encompassed the case where a peptidic linker is not needed to fuse a catalytical domain to the TALE scaffold in order to obtain a cTALEN according to the present invention.

Depending from its structural composition [type of core TALE scaffold, type of catalytic domain(s) with associated enzymatic activities and eventually type of linker(s)], a compact TALEN according to the present invention can comprise different levels of separate enzymatic activities able to differently process DNA, resulting in a global DNA processing efficiency for said compact TALEN, each one of said different enzymatic activities having their own DNA processing efficiency.

In another preferred embodiment, the compact TALEN according to the present invention further comprises:
(i) at least one enhancer domain;
(ii) Optionally one peptide linker to fuse said enhancer domain to one part of said compact TALEN active entity;
thereby obtaining a compact TALEN entity with enhanced DNA processing efficiency nearby a single double-stranded DNA target sequence of interest, i.e an enhanced compact TALEN.

In other words, said unique compact TALEN monomer further comprises:
(i) At least one enhancer domain;
(ii) Optionally one peptide linker to fuse said enhancer domain to one part of said unique compact TALEN monomer active entity.

In another more preferred embodiment, said enhancer domain is fused to N-terminus of the core TALE scaffold part of said compact TALEN entity. In another more preferred embodiment, said enhancer domain is fused to C-terminus of the core TALE scaffold part of said compact TALEN entity. In another more preferred embodiment, said enhancer domain is fused to the catalytic domain part of said compact TALEN entity. In another more preferred embodiment, said enhancer domain is fused between the N-terminus part of the core TALE scaffold and the catalytic part of said compact TALEN entity. In another more preferred embodiment, said enhancer domain is fused between the C-terminus part of the core TALE scaffold and the catalytic part of said compact TALEN entity. In the scope of the present invention, it can be envisioned to insert said catalytic domain and/or enhancer domain between two parts of the engineered core TALE scaffold according to the invention, each part comprising one set of RVDs. In this last case, the number of RVDs for each engineered core TALE scaffold can be the same or not. In other words, it can be envisioned to split said core TALE scaffold of the present invention to insert one catalytic domain and/or one enhancer domain between the resulting two parts of said engineered core TALE scaffold.

In another preferred embodiment, said enhancer domain is catalytically active or not, providing functional and/or structural support to said compact TALEN entity. In a more preferred embodiment, said enhancer domain consists of a protein domain selected from the group consisting of MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E. coli* ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative of these protein domains thereof. In another more preferred embodiment, said enhancer domain consists of a catalytically active derivative of the protein domains listed above and in Table 2, providing functional and/or structural support to said compact TALEN entity. In another preferred embodiment, said enhancer domain consists of a catalytically inactive derivative of the protein domains listed above and in Table 2, providing structural support to said compact TALEN entity. In another preferred embodiment, said enhancer domain is selected from the group consisting of I-TevI (SEQ ID NO: 20), ColE7 (SEQ ID NO: 11) and NucA (SEQ ID NO: 26).

In a more preferred embodiment, said enhanced compact TALEN according to the present invention can comprise a second enhancer domain. In this embodiment, said second enhancer domain can have the same characteristics than the first enhancer domain. In a more preferred embodiment, said second enhancer domain provides structural support to enhanced compact TALEN entity. In another more preferred embodiment, said second enhancer domain provides functional support to enhanced compact TALEN entity. In a more preferred embodiment, said second enhancer domain provides structural and functional supports to enhanced compact TALEN entity. In a more preferred embodiment, said enhanced compact TALEN entity comprises one catalytic domain and one enhancer domain. In another more preferred embodiment said enhanced compact TALEN entity comprises one catalytic domain and two enhancer domains. In another more preferred embodiment said enhanced compact TALEN entity comprises two catalytic domains and one enhancer domains. In another more preferred embodiment said enhanced compact TALEN entity comprises two catalytic domains and two enhancer domains.

In a more preferred embodiment, said second enhancer domain consists of a protein domain derived from a protein selected from the group consisting of MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E. coli* ExoI, Human TREX2, Mouse TREX1, Human TREX1, Bovine TREX1, Rat TREX1, Human DNA2, Yeast DNA2 (DNA2_YEAST) and VP16, as listed in Table 2 (SEQ ID NO: 10 to SEQ ID NO: 66 and SEQ ID NO: 1, 366 & 367), a functional mutant, a variant or a derivative of these protein domains thereof. In another more preferred embodiment, said second enhancer domain consists of a catalytically active derivative of the protein domains listed above and in Table 2, providing functional and/or structural support to said enhanced compact TALEN entity. In another preferred embodiment, said second enhancer domain consists of a catalytically inactive derivative of the protein domains listed above and in Table 2, providing structural support to said enhanced compact TALEN entity.

In another more preferred embodiment, any combinations of catalytic and/or enhancer domains listed above, as non-limiting examples, can be envisioned to be fused to said core TALE scaffold providing structural and/or functional support to said compact TALEN entity. More preferably, combinations of catalytic domains listed in Table 14. Again more preferably, combinations of catalytic domains selected from the group of TevI (SEQ ID NO: 20), ColE7 (SEQ ID NO: 11) and NucA (SEQ ID NO: 26) can be envisioned. Optionally, FokI (SEQ ID NO: 368) can be used in combination with another catalytic domain according to the list of Table 2. Such combinations of catalytic and/or enhancer domains can be envisioned regarding the envisioned applications for using the method of the present invention.

Depending from its structural composition [type of core TALE scaffold, type of catalytic domain(s) with associated enzymatic activities, type of linker(s) and type of enhancer(s) domains], an enhanced compact TALEN according to the present invention can present different levels of separate enzymatic activities able to differently process DNA, resulting in a global DNA processing efficiency for said enhanced compact TALEN, each one of said different enzymatic activities having their own DNA processing efficiency.

In this preferred embodiment, the DNA processing efficiency of the compact TALEN entity according to the present invention can be enhanced by the engineering of at least one enhancer domain and one peptidic linker thereby obtaining a compact TALEN entity with enhanced DNA processing activity nearby a single double-stranded DNA target sequence of interest, i.e a enhanced compact TALEN according to the present invention.

Depending from its structural composition, the global DNA processing efficiency that is enhanced in said enhanced compact TALEN according to the present invention, can have a dominant enzymatic activity selected from the group consisting of a nuclease activity, a polymerase activity, a kinase activity, a phosphatase activity; a methylase activity, a topoisomerase activity, an integrase activity, a transposase activity or a ligase activity as non-limiting examples. In a more preferred embodiment, the global DNA processing efficiency that is enhanced in said enhanced compact TALEN according to the present invention is a combination of different enzymatic activities selected from the group consisting of a nuclease activity, a polymerase activity, a kinase activity, a phosphatase activity, a methylase activity, a topoisomerase activity, an integrase activity, a transposase activity or a ligase activity as non-limiting examples. In a more preferred embodiment, the global DNA processing efficiency that is enhanced in said enhanced compact TALEN according to the present invention is one of its different enzymatic activities selected from the group consisting of a nuclease activity, a polymerase activity, a kinase activity, a phosphatase activity, a methylase activity, a topoisomerase activity, an integrase activity, a transposase activity or a ligase activity as non-limiting examples. In this case, the global DNA processing efficiency is equivalent to one DNA processing activity amongst the enzymatic activities mentioned above. In another more preferred embodiment, said DNA processing activity of the compact TALEN entity which is enhanced by the enhancer is a cleavase activity or a nickase activity or a combination of both a cleavase activity and a nickase activity.

Enhancement of DNA processing efficiency of a compact TALEN entity according to the present invention can be a consequence of a structural support by said at least one enhancer domain. In a preferred embodiment, said structural support enhances the binding of a compact TALEN entity according to the invention for said DNA target sequence compared to the binding of a starting compact TALEN entity for the same DNA target sequence, thereby indirectly assisting the catalytic domain(s) to obtain a compact TALEN entity with enhanced DNA processing activity. In another preferred embodiment, said structural support enhances the existing catalytical activity of a compact TALEN entity for a DNA target sequence compared to the binding of a starting compact TALEN entity for the same DNA target sequence to obtain a compact TALEN entity with enhanced DNA processing activity.

In another preferred embodiment, said enhancer according to the present invention both enhances the binding of the compact TALEN entity for said DNA target sequence and the catalytic activity of the catalytic domain(s) to obtain a compact TALEN entity with enhanced DNA processing activity. All these non-limiting examples lead to a compact TALEN entity with enhanced DNA processing efficiency for a DNA target sequence at a genomic locus of interest, i.e an enhanced compact TALEN according to the present invention.

Enhancement of DNA processing efficiency of a compact TALEN entity according to the present invention, compared to a starting compact TALEN entity, can also be a consequence of a fuctional support by said at least one enhancer domain. In a preferred embodiment, said functional support can be the consequence of the hydrolysis of additional phosphodiester bonds. In a more preferred embodiment, said functional support can be the hydrolysis of additional phosphodiester bonds by a protein domain derived from a nuclease. In a more preferred embodiment, said functional support can be the hydrolysis of additional phosphodiester bonds by a protein domain derived from an endonuclease. In a more preferred embodiment, said functional support can be the hydrolysis of additional phosphodiester bonds by a protein domain derived from a cleavase. In another more preferred embodiment, said functional support can be the hydrolysis of additional phosphodiester bonds by a protein domain derived from a nickase. In a more preferred embodiment, said functional support can be the hydrolysis of additional phosphodiester bonds by a protein domain derived from an exonuclease.

In genome engineering experiments, the efficiency of rare-cutting endonuclease, e.g. their ability to induce a desired event (Homologous gene targeting, targeted mutagenesis, sequence removal or excision) at a locus, depends on several parameters, including the specific activity of the nuclease, probably the accessibility of the target, and the efficacy and outcome of the repair pathway(s) resulting in the desired event (homologous repair for gene targeting, NHEJ pathways for targeted mutagenesis).

Cleavage by peptidic rare cutting endonucleases usually generates cohesive ends, with 3' overhangs for LAGLIDADG meganucleases (Chevalier and Stoddard 2001) and 5' overhangs for Zinc Finger Nucleases (Smith, Bibikova et al. 2000). These ends, which result from hydrolysis of phosphodiester bonds, can be re-ligated in vivo by NHEJ in a seamless way (i.e a scarless re-ligation). The restoration of a cleavable target sequence allows for a new cleavage event by the same endonuclease, and thus, a series of futile cycles of cleavage and re-ligation events can take place. Indirect evidences have shown that even in the yeast *Saccharomyces cerevisiae*, such cycles could take place upon continuous cleavage by the HO endonuclease (Lee, Paques et al. 1999). In mammalian cells, several experiment have shown that perfect re-ligation of compatible cohesive ends resulting from two independent but close I-SceI-induced DSBs is an efficient process (Guirouilh-Barbat, Huck et al. 2004; Guirouilh-Barbat, Rass et al. 2007; Bennardo, Cheng et al. 2008; Bennardo, Gunn et al. 2009). Absence of the Ku DNA repair protein does not significantly affect the overall frequency of NHEJ events rejoining the ends from the two DSBs; however it very strongly enhances the contribution of imprecise NHEJ to the repair process in CHO immortalized cells and mouse ES cells (Guirouilh-Barbat, Huck et al. 2004; Guirouilh-Barbat, Rass et al. 2007; Bennardo, Cheng et al. 2008). Furthermore, the absence of Ku stimulates I-SceI-induced events such as imprecise NHEJ (Bennardo, Cheng et al. 2008), single-strand annealing (Bennardo, Cheng et al. 2008) and gene conversion (Pierce, Hu et al. 2001; Bennardo, Cheng et al. 2008) in mouse ES cells. Similar observations shave been made with cells deficient for the XRCC4 repair protein (Pierce, Hu et al. 2001; Guirouilh-Barbat, Rass et al. 2007; Bennardo, Gunn et al. 2009) (although XRCC4 deficiency affects the overall level of NHEJ in CHO cells (Guirouilh-Barbat, Rass et al. 2007)) or for DNA-PK (Pierce, Hu et al. 2001). In contrast, knockdown of CtP has been shown to suppresses "alt-NHEJ" (a Ku- and XRCC4-independent form of NHEJ more prone to result in imprecise NHEJ), single-strand annealing and gene conversion, while not affecting the overall level of rejoining of two compatible ends generated by I-SceI (Bennardo, Cheng et al. 2008). Thus, competition between different DSB repair pathways can affect the spectrum or repair events resulting from a nuclease-induced DSB.

In addition, DSB resection is important for certain DSB pathways. Extensive DSB resection, resulting in the generation of large single stranded regions (a few hundred nucleotides at least), has been shown in yeast to initiate single strand annealing (Sugawara and Haber 1992) and strand invasion, the ATP-dependant step that initiates many homologous recombination events of DNA duplex invasion by an homologous strand that (White and Haber 1990; Sun, Treco et al. 1991) (for a review of mechanisms, see (Paques and Haber 1999)). In eukaryotic cells DSB resection depends on several proteins including BLM/Sgs1 and DNA2, EXOI, and the MRN complex (Mre11, Rad50, Nbs1/Xrs2) and is thought to result from different pathways. MRN is involved in a small scale resection process, while two redundant pathways depending on BLM and DNA2 on one hand, and on EXOI on another hand, would be involved in extensive resection (Mimitou and Symington 2008; Nimonkar, Genschel et al. 2011). In addition, processing ends involving a damaged nucleotide (resulting from chemical cleavage or from a bulk adduct), requires the CtIP/Sae2 protein together with RMN (Sartori, Lukas et al. 2007; Buis, Wu et al. 2008; Hartsuiker, Mizuno et al. 2009).

Over-expression of the Trex2 exonuclease was shown to strongly stimulate imperfect NHEJ associated with loss of only a few base pairs (Bennardo, Gunn et al. 2009), while it inhibited various kinds of DNA repair events between distant sequences (such as Single-strand annealing, NHEJ between ends from different breaks, or NHEJ repair of a single DSB involving remote micro-homologies). In the same study, it was suggested that Trex2 did reset the 3' overhangs let by I-SceI in a non processive way. Thus, the type of stimulated pathway could in turn depend on the type of resection (length of resection, single strand vs. double strand, resection of 5' strand vs. 3' strand).

Thus, the efficiency of a compact TALEN, e.g. it ability to produce a desired event such as targeted mutagenesis or homologous gene targeting (see definition for full definition of "efficiency of compact TALEN"), can be enhanced by an enhancement or modification of its global DNA processing efficiency (see definition for full definition of "global DNA processing efficiency"), e.g. the global resultant or the overall result of different separate enzymatic activities that said compact TALEN.

In a preferred embodiment, enhancement of global DNA processing efficiency of a compact TALEN entity according to the present invention, compared to a starting compact TALEN entity, can be the hydrolysis of additional phosphodiester bonds at the cleavage site.

Said hydrolysis of additional phosphodiester bonds at the cleavage site by said at least one enhancer according to the invention can lead to different types of DSB resection affecting at said DSB cleavage site, one single DNA strand or both DNA strands, affecting either 5' overhangs ends, either 3' overhangs ends, or both ends and depending on the length of said resection. Thus, adding new nickase or cleavase activities to the existing cleavase activity of a compact TALEN entity can enhance the efficiency of the resulting enhanced compact TALEN according to the invention, at a genomic locus of interest (FIG. 8B-8E). As a non-limiting example, addition of two nickase activities on opposite strands (FIG. 8D) or of a new cleavase activity generating a second DSB (FIG. 8E) can result in a double-strand gap. As a consequence, perfect religation is not possible anymore, and one or several alternative repair outcomes such as imprecise NHEJ, Homologous Recombination or SSA for instance, can be stimulated. As another non-limiting example, the addition of a single nickase activity can result in a single strand gap, and suppress the cohesivity of the ends, which can also enhances the efficiency of the resulting enhanced compact TALEN at a genomic locus of interest, according to the invention, via stimulation of one or several alternative repair outcomes mentioned above.

In this aspect of the present invention, enhancement of DNA processing efficiency of a compact TALEN refers to the increase in the detected level of said DNA processing efficiency, against a target DNA sequence, of a compact TALEN in comparison to the activity of a first compact TALEN against the same target DNA sequence. Said first compact TALEN can be a starting compact TALEN, or a compact TALEN that has already been engineered or an enhanced compact TALEN according to the present invention. Several rounds of enhancement can be envisioned from a starting compact TALEN or from a starting enhanced compact TALEN.

In this aspect of the present invention, enhancement of the DNA processing efficiency of the compact TALEN entity (or enhanced compact TALEN) refers to the increase in the detected level of said DNA processing efficiency against a target DNA sequence of interest or nearby said DNA sequence of interest in comparison to the efficiency of a first compact TALEN or starting compact TALEN against or nearby the same target DNA sequence. In this case, the starting compact TALEN is taken as the reference scaffold to measure the DNA processing efficiency. Said enhanced compact TALEN is an engineered compact TALEN comprising an enhancer domain according to this aspect of the invention. Said enhanced compact TALEN can also be taken as a reference scaffold for further enhancement in said DNA processing efficiency. As a non-limiting example, said DNA processing efficiency can result from a cleavage-induced recombination generated by said enhanced compact TALEN. In this case, said level of cleavage-induced recombination can be determined, for instance, by a cell-based recombination assay as described in the International PCT Application WO 2004/067736. Importantly, enhancement of efficacy in cells (enhanced generation of targeted mutagenesis or targeted recombination) can be, but is not necessarily associated with an enhancement of the cleavage activity that could be detected in certain in vitro assays. For example, additional phosphodiesterase activities as described in FIG. 8 could barely affect the cleavage profile, as detected by in vitro cleavage and separation of the cleavage products on an electrophoresis gel. However, as explained above, and in the legend of FIG. 8, the DSB ends generated in this way could be more prone to induce detectable genomic rearrangements such as targeted mutagenesis (by imprecise NHEJ) or homologous recombination. Said enhancement in cleavage-induced recombination of said enhanced compact TALEN is at least a 5% enhancement compared to the starting scaffold or starting compact TALEN, more preferably at least a 10% enhancement, again more preferably at least a 15% enhancement, again more preferably at least a 20% enhancement, again more preferably at least a 25% enhancement, again more preferably a 50% enhancement, again more preferably a enhancement greater than 50%, resulting in an enhancement of DNA processing efficiency of said enhanced compact TALEN of at least 5% compared to the starting scaffold or starting compact TALEN, more preferably at least a 10% enhancement, again more preferably at least a 15% enhancement, again more preferably at least a 20% enhancement, again more preferably at least a 25% enhancement, again more preferably a 50% enhancement, again more preferably a enhancement greater than 50%.

In another preferred embodiment according to the method of the present invention, the peptidic linker that can link said enhancer domain to one part of said compact TALEN entity according to the method of the present invention can be selected from the group consisting of NFS1, NFS2, CFS1, RM2, BQY, QGPSG (SEQ ID NO:103), LGPDGRKA (SEQ ID NO:104), 1a8h_1, 1dnpA_1, 1d8cA_2, 1ckqA_3, 1sbp_1, 1ev7A_1, 1alo_3, 1amf_1, 1adjA_3, 1fcdC_1, 1al3_2, 1g3p_1, 1acc_3, 1ahjB_1, 1acc_1, 1af7_1, 1heiA_1, 1bia_2, 1igtB_1, 1nfkA_1, 1au7A_1, 1bpoB_1, 1b0pA_2, 1c05A_2, 1gcb_1, 1bt3A_1, 1b3oB_2, 16vpA_6, 1dhx_1, 1b8aA_1 and 1qu6A_1 as listed in table 3 (SEQ ID NO: 67 to SEQ ID NO: 104 and SEQ ID NO: 372 to SEQ ID NO: 415). In a more preferred embodiment, the peptidic linker that can said enhancer domain to one part of said compact TALEN entity according to the method of the present invention can be selected from the group consisting of NFS1 (SEQ ID NO: 98), NFS2 (SEQ ID NO: 99) and CFS1 (SEQ ID NO: 100). In the scope of the present invention is also encompassed the case where a peptidic linker is not needed to fuse one enhancer domain to one part of said compact TALEN entity in order to obtain a enhanced compact TALEN according to the present invention.

Depending from its structural composition [type of core TALE scaffold, type of catalytic domain(s) with associated enzymatic activities, type of enhancers and eventually type of linker(s)], a compact TALEN or an enhanced compact TALEN according to the present invention can comprise different levels of separate enzymatic activities able to differently process DNA as mentioned above. By adding new enzymatic activities to said compact TALEN or enhanced compact TALEN or enhancing the DNA processing efficiency of one or several of its constitutive enzymatic activities, one can enhance the global DNA processing efficiency of one compact TALEN or enhanced compact TALEN in comparison to a starting compact TALEN or enhanced compact TALEN.

According to the present invention, compact TALENs are designed to alleviate the need for multiple independent protein moieties when targeting a DNA processing event. Importantly, the requisite "spacer" region and dual target sites essential for the function of current TALENs are unnecessary, as compact TALENs according to the invention comprises a core TALE scaffold containing only one DNA binding domain to target a specific single double-stranded DNA target sequence of interest and process DNA nearby said single double-stranded DNA target sequence of interest. As each end of the core TALE scaffold is amenable to fusion; the order (N- vs. C-terminal) of addition of the catalytic and enhancement domains can vary with the application. In addition, since the catalytic domain does not require specific DNA contacts, there are no restrictions on regions surrounding the core TALE scaffold, as non-limiting examples depicted in FIG. 5: (A) N-terminal fusion construct to promote Homologous recombination induced by a cleavase domain or by a nickase domain. (B) C-terminal fusion construct with properties as in (A). (C) The attachment of two catalytic domains to both ends of the core TALE scaffold allows for dual cleavage with enhancement in NHEJ. Fusion junctions (N- vs. C-terminal) and linker designs can vary with the application.

According to the present invention, compact TALENs can be enhanced through the addition of a domain to promote existing or alternate activities as non-limiting examples depicted in FIG. 6: (A) A standard compact TALEN with an enhancer domain fused to the C-terminus of its core TALE scaffold part. (B) The enhancer domain is fused to the compact TALEN via the N-terminus of its catalytic domain part. Such a configuration can be used to assist and/or anchor the catalytic domain part near the DNA to increase DNA processing activity. (C) The enhancer domain is sandwiched between the catalytic domain part and the core TALE scaffold part. The enhancer domain can promote communication between the flanking domains (i.e. to assist in catalysis and/or DNA binding) or can be used to overcome the requisite T nucleotide at position −1 of all TALE-based targets. (D) The enhancer domain is used to functionally replace the engineered core TALE scaffold N-terminal region. (E) The enhancer domain is used to functionally replace the engineered core TALE scaffold C-terminal region. Fusion junctions (N- vs. C-terminal) and linker designs can vary with the application.

According to the present invention, the nature of the catalytic domain(s) comprised in the compact TALEN and the enhanced compact TALEN is application dependent. As a non-limiting example, a nickase domain should allow for a higher HR/NHEJ ratio than a cleavase domain, thereby being more agreeable for therapeutic applications (McConnell Smith, Takeuchi et al. 2009; Metzger, McConnell-Smith et al. 2011). For example, the coupling of a cleavase domain on one side with a nickase domain on the other could result in excision of a single-strand of DNA spanning the binding region of a compact TALEN. The targeted generation of extended single-strand overhangs could be applied in applications that target DNA repair mechanisms. For targeted gene inactivation, the use of two cleavase domains is then preferred. In another preferred embodiment, the use of two nickase domains can be favored. Furthermore, the invention relates to a method for generating several distinct types of compact TALENs that can be applied to applications ranging from targeted DNA cleavage to targeted gene regulation.

The present invention also relates to methods for use of said compact TALENs according to the invention for various applications ranging from targeted DNA cleavage to targeted gene regulation. In a preferred embodiment, the present invention relates to a method for increasing targeted HR (and NHEJ) when Double-Strand break activity is promoted in a compact TALEN targeting a DNA target sequence according to the invention. In another more preferred embodiment, the addition of at least two catalytically active cleavase enhancer domains according to the invention allows to increase Double-strand break-induced mutagenesis by leading to a loss of genetic information and preventing any scarless re-ligation of targeted genomic locus of interest by NHEJ.

In another preferred embodiment, the present invention relates to a method for increasing targeted HR with less NHEJ (i.e in a more conservative fashion) when Single-Strand Break activity is promoted in a compact TALEN targeting a DNA target sequence according to the invention.

In another preferred embodiment, the present invention relates to a method for increasing excision of a single-strand of DNA spanning the binding region of a compact TALEN when both one cleavase enhancer domain and one nickase enhancer domain, respectively, are fused to both N-terminus and C-terminus of a core TALE scaffold according to the invention.

In another preferred embodiment, the present invention relates to a method for treatment of a genetic disease caused by a mutation in a specific single double-stranded DNA target sequence in a gene, comprising administering to a subject in need thereof an effective amount of a variant of a compact TALEN according to the present invention.

In another preferred embodiment, the present invention relates to a method for inserting a transgene into a specific single double-stranded DNA target sequence of a genomic locus of a cell, tissue or non-human animal, or a plant wherein at least one compact TALEN of the present invention is transitory or not introduced into said cell, tissue, non-human animal or plant.

In another embodiment, the present invention relates to a method to modulate the activity of a compact TALEN when expressed in a cell wherein said method comprises the step of introducing in said cell an auxiliary domain modulating the activity of said compact TALEN. In a preferred embodiment, the present invention relates to a method which allows to have a temporal control of activity of a compact TALEN when expressed in a cell by introducing in said cell an auxiliary domain modulating the activity of said compact TALEN once said compact TALEN achieved its activity (DNA cleavage, DNA nicking or other DNA processing activities). In a preferred embodiment, the present invention relates to a method to inhibit the activity of a compact TALEN when expressed in a cell wherein said method comprises the step of introducing in said cell an auxiliary domain inhibiting the activity of said compact TALEN. In a more preferred embodiment, the catalytic domain of said compact TALEN is NucA (SEQ ID NO: 26) and said auxiliary domain is NuiA (SEQ ID NO: 229), a functional mutant, a variant or a derivative thereof. In another more preferred embodiment, the catalytic domain of said compact TALEN is ColE7 (SEQ ID NO: 11) and said auxiliary domain is Im7 (SEQ ID NO: 230), a functional mutant, a variant or a derivative thereof.

Is also encompassed in the scope of the present invention a recombinant polynucleotide encoding a compact TALEN, a dual compact TALEN, or an enhanced compact TALEN according to the present invention. Is also encompassed in the scope of the present invention, a vector comprising a recombinant polynucleotide encoding for a compact TALEN or an enhanced compact TALEN according to the present invention.

Is also encompassed in the scope of the present invention, a host cell which comprises a vector and/or a recombinant polynucleotide encoding for a compact TALEN or an enhanced compact TALEN according to the present invention.

Is also encompassed in the scope of the present invention, a non-human transgenic animal comprising a vector and/or a recombinant polynucleotide encoding for a compact TALEN or an enhanced compact TALEN according to the present invention.

Is also encompassed in the scope of the present invention, a transgenic plant comprising a vector and/or a recombinant polynucleotide encoding for a compact TALEN or an enhanced compact TALEN according to the present invention.

The present invention also relates to kits used to implement the method according to the present invention. More preferably, is encompassed in the scope of the present invention, a kit comprising a compact TALEN or an enhanced compact TALEN according to the present invention and instructions for use said kit in enhancing DNA processing efficiency of a single double-stranded DNA target sequence of interest.

For purposes of therapy, the compact TALENs of the present invention and a pharmaceutically acceptable excipient are administered in a therapeutically effective amount. Such a combination is said to be administered in a "therapeutically effective amount" if the amount administered is physiologically significant. An agent is physiologically significant if its presence results in a detectable change in the physiology of the recipient. In the present context, an agent is physiologically significant if its presence results in a decrease in the severity of one or more symptoms of the targeted disease and in a genome correction of the lesion or abnormality. Vectors comprising targeting DNA and/or nucleic acid encoding a compact TALEN can be introduced into a cell by a variety of methods (e.g., injection, direct uptake, projectile bombardment, liposomes, electroporation). Compact TALENs can be stably or transiently expressed into cells using expression vectors. Techniques of expression in eukaryotic cells are well known to those in the art. (See Current Protocols in Human Genetics: Chapter 12 "Vectors For Gene Therapy" & Chapter 13 "Delivery Systems for Gene Therapy").

In one further aspect of the present invention, the compact TALEN of the present invention is substantially non-immunogenic, i.e., engender little or no adverse immunological response. A variety of methods for ameliorating or eliminating deleterious immunological reactions of this sort can be used in accordance with the invention. In a preferred embodiment, the compact TALEN is substantially free of N-formyl methionine. Another way to avoid unwanted immunological reactions is to conjugate compact TALEN to polyethylene glycol ("PEG") or polypropylene glycol ("PPG") (preferably of 500 to 20,000 daltons average molecular weight (MW)). Conjugation with PEG or PPG, as described by Davis et al. (U.S. Pat. No. 4,179,337) for example, can provide non-immunogenic, physiologically active, water soluble compact TALEN conjugates with antiviral activity. Similar methods also using a polyethylene-polypropylene glycol copolymer are described in Saifer et al. (U.S. Pat. No. 5,006,333).

In another aspect of the present invention is a composition comprising a compact TALEN or an enhanced compact TALEN according to the present invention and a carrier. More preferably, is a pharmaceutical composition comprising a compact TALEN or an enhanced compact TALEN according to the present invention and a pharmaceutically active carrier known in the state of the art.

In the scope of the present invention and for all the applications mentioned above, it can be envisioned to use more than one compact TALEN (i.e one compact TALEN active entity) or more than one enhanced compact TALENs (i.e one enhanced compact TALEN active entity) for DNA processing according to the invention. In a preferred embodiment, two different compact TALENs or two enhanced compact TALENs can be used. In this embodiment, as non-limiting examples, said two different compact TALENs can comprise the same core TALE scaffold or not; said two different compact TALENs can comprise the same set of Repeat Variable Dipeptides or not; said two different compact TALENs can comprise the same catalytic domain or not. When two identical compact TALENs active entities are used for DNA processing according to the invention, they can be considered as a homodimeric pair of compact TALENs active entities. When two non identical compact TALENs active entities are used for DNA processing according to the invention, they can be considered as a heterodimeric pair of compact TALENs active entities. As non-limiting example, when two compact TALEN according to the present invention are used, one of the compact TALEN can modulate the activity of the other one, leading for instance to an enhanced DNA processing event compared to the same DNA processing event achieved by only one compact TALEN; in this non-limiting example, a Trans-TALEN modulates and enhances the catalytic activity of an initial compact TALEN.

In another preferred embodiment, three compact TALENs or three enhanced compact TALENs can be used. In another preferred embodiment, more than three compact TALENs or three enhanced compact TALENs can be used for DNA processing according to the invention. In another preferred embodiment, a combination of compact TALENs and enhanced compact TALENs can be used for DNA processing according to the invention. As a non-limiting example, one compact TALEN and one enhanced compact TALEN can be used. As another non-limiting example, one compact TALEN and one dual-cleavage compact TALEN can be used. In another preferred embodiment, a combination of compact TALENs, enhanced compact TALENs and dual-cleavage compact TALENs can be used, said compact TALENs comprising the same catalytic domain or not, the same core TALE scaffold or not. When several compact TALENs have to be used, DNA target sequence for each compact TALENs of the combination to be used can be located on a same endogenous genomic DNA locus of interest or not. Said DNA target sequences can be located at an approximative distance of 1000 base pairs (bps). More preferably, said DNA target sequences can be located at an approximative distance of 500 bps or 200 bps, or 100 bps, or 50 bps, or 20 bps, 19 bps, 18 bps, 17 bps, 16 bps, 15 bps, 14 bps, 13 bps, 12 bps, 11 bps, 10 bps, 9 bps, 8 bps, 7 bps, 6 bps, 5 bps, 4 bps, 3 bps, 2 bps, 1 bp. Said DNA target sequences located at distances mentioned above are "nearby" DNA sequences in reference to the target DNA sequence for DNA processing according to the present invention.

In another preferred embodiment, two compact TALENs active entities can be used as a way of achieving two different DNA processing activities nearby a DNA target sequence according to the invention. As a non-limiting example, two compact TALENs targeting said DNA sequence or DNA sequences nearby said targeted DNA sequence and comprising each one a nickase-derived catalytic domain can be used; in this case, this use of two compact TALENs active entities can represent an alternative way of achieving a Double Strand Break nearby a said DNA target sequence, compared to the use of one compact TALEN targeting said DNA sequence and comprising a cleavase-derived catalytic domain, or not. As another non-limiting example, one compact TALEN comprising a cleavase-derived domain and one compact TALEN comprising an exonuclease-derived domain can be used to make a Double Strand Break and create a gap, respectively, to achieve an imprecise NHEJ event at the genomic locus of interest comprising said DNA target sequence. In this case, even if each compact TALEN forming this heterodimeric pair of compact TALENs is active by itself, each of these active entities is dependent of the other one to achieve the wanted resulting DNA processing activity. Indeed, in this particular case, the wanted resulting activity is a gap created by the exonuclease activity, said exonuclease activity being possible only from the Double Strand Break achieved by the cleavase domain of the other compact TALENs. In the scope of the present invention, is also envisioned the case where two identical compact TALEN active entities (a homodimeric pair of compact TALENs) are dependent each other to achieve a wanted resulting DNA processing activity.

Definitions

Amino acid residues in a polypeptide sequence are designated herein according to the one-letter code, in which, for example, Q means Gln or Glutamine residue, R means Arg or Arginine residue and D means Asp or Aspartic acid residue.

Amino acid substitution means the replacement of one amino acid residue with another, for instance the replacement of an Arginine residue with a Glutamine residue in a peptide sequence is an amino acid substitution.

Enhanced/increased/improved DNA processing activity, refers to an increase in the detected level of a given compact TALEN or enhanced compact TALEN associated DNA processing activity against a target DNA sequence or DNA target sequence by a second compact TALEN or enhanced compact TALEN in comparison to the activity of a first compact TALEN or enhanced compact TALEN against the target DNA sequence. The second compact TALEN or enhanced compact TALEN can be a variant of the first one and can comprise one or more substituted amino acid residues in comparison to the first compact TALEN or enhanced compact TALEN. The second compact TALEN or enhanced compact TALEN can be a variant of the first one and can comprise one or more catalytic and/or enhancer domains in comparison to said first compact TALEN or enhanced compact TALEN. This definition more broadly applies for other endonucleases and rare-cutting endonucleases.

DNA processing activity refers to a particular/given enzymatic activity of said compact TALEN or enhanced compact TALEN or more broadly to qualify the enzymatic activity of a rare-cutting endonuclease. Said DNA processing activity can refer to a cleavage activity, either a cleavase activity either a nickase activity, more broadly a nuclease activity but also a polymerase activity, a kinase activity, a phosphatase activity, a methylase activity, a topoisomerase activity, an integrase activity, a transposase activity or a ligase activity as non-limiting examples. In the scope of this definition, said given DNA processing activity of a particular enzymatic activity can also be described as DNA processing efficiency of said particular enzymatic activity. Methods for enhancing compact TALEN or enhanced compact TALEN DNA processing activity according to this definition are encompassed in the present invention.

Global DNA processing efficiency describes, for a compact TALEN or an enhanced compact TALEN according to the present invention, the global resultant or the overall effect of different separate enzymatic activities that said compact TALEN or enhanced compact TALEN can comprise. According to these different separate enzymatic activities, a compact TALEN or an enhanced compact TALEN presents a global capacity to process DNA nearby a target sequence in a genomic locus of interest, i.e a global DNA processing efficiency. Said global DNA processing efficiency can qualify or rank a second given compact TALEN or enhanced compact TALEN in comparison to a first given compact TALEN or enhanced compact TALEN. Depending on said compact TALENs or enhanced compact TALENs structural composition [type of core TALE scaffold, type of catalytic domain(s) with associated enzymatic activities, eventually type of linker(s) and type of enhancer(s) domains], said global DNA processing efficiency can refer to only one enzymatic activity, two enzymatic activities, three enzymatic activities, four enzymatic activities or more than four enzymatic activities. Said global DNA processing efficiency can refer to the sum of individual enzymatic activities. Said global DNA processing efficiency can refer to the synergy or combined effect of different enzymatic activities comprised in a given compact TALEN or enhanced compact TALEN. An enhancement of the DNA processing efficiency of a compact TALEN according to the present invention can reflect a synergy, an enhanced combined effect, resulting in an enhanced compact TALEN characterized by a global DNA processing efficiency that is greater than the sum of respective DNA processing efficiencies of separate starting compact TALEN or than the sum of respective DNA processing efficiencies of separate enzymatic activities comprised in a same starting compact TALEN.

Efficiency of a rare-cutting endonuclease according to the present invention is the property for said rare-cutting endonuclease of producing a desired event. This desired event can be for example Homologous gene targeting, targeted mutagenesis, or sequence removal or excision. The efficiency of the desired event depends on several parameters, including the specific activity of the nuclease and the repair pathway(s) resulting in the desired event (efficacy of homologous repair for gene targeting, efficacy and outcome of NHEJ pathways for targeted mutagenesis). Efficiency of a rare cutting endonuclease for a locus is intended to mean its ability to produce a desired event at this locus. Efficiency of a rare cutting endonuclease for a target is intended to mean its ability to produce a desired event as a consequence of cleavage of this target.

Nucleotides are designated as follows: one-letter code is used for designating the base of a nucleoside: a is adenine, t is thymine, c is cytosine, and g is guanine. For the degenerated nucleotides, r represents g or a (purine nucleotides), k represents g or t, s represents g or c, w represents a or t, m represents a or c, y represents t or c (pyrimidine nucleotides), d represents g, a or t, v represents g, a or c, b represents g, t or c, h represents a, t or c, and n represents g, a, t or c.

by "meganuclease", is intended a rare-cutting endonuclease subtype having a double-stranded DNA target sequence greater than 12 bp. Said meganuclease is either a dimeric enzyme, wherein each domain is on a monomer or a monomeric enzyme comprising the two domains on a single polypeptide.

by "meganuclease domain" is intended the region which interacts with one half of the DNA target of a meganuclease and is able to associate with the other domain of the same meganuclease which interacts with the other half of the DNA target to form a functional meganuclease able to cleave said DNA target.

by "endonuclease variant", "rare-cutting endonuclease variant", "chimeric rare-cutting endonuclease variant" or "meganuclease variant" or "compact TALEN variant", or "enhanced compact TALEN variant" or "dual cleavage compact TALEN variant" or "variant" it is intended an endonuclease, rare-cutting endonuclease, chimeric rare-cutting endonuclease, meganuclease, or compact TALEN, enhanced compact TALEN, dual cleavage compact TALEN obtained by replacement of at least one residue in the amino acid sequence of the parent meganuclease, rare-cutting endonuclease, chimeric rare-cutting endonuclease, meganuclease or compact TALEN, enhanced compact TALEN, dual cleavage compact TALEN with at least a different amino acid. "Variant" designation also applies for instance for an enhanced compact TALEN comprising at least one supplementary protein domain (catalytic or enhancer domain) in comparison to the starting compact TALEN entity. Are also encompassed in the scope of the present definition, variants and protein domains comprised in these variants which present a sequence with high percentage of identity or high percentage of homology with sequences of compact TALENs, enhanced compact TALENs, dual-cleavage compact TALENs or protein domains and polypeptides according to the present invention, at nucleotidic or polypeptidic levels. By high percentage of identity or high percentage of homology it is intended 60%, more preferably 70%, more preferably 75%, more preferably 80%, more preferably 85%, more preferably 90%, more preferably 95, more preferably 97%, more preferably 99% or any integer comprised between 60% and 99%.

by "peptide linker", "peptidic linker" or "peptide spacer" it is intended to mean a peptide sequence which allows the connection of different monomers in a fusion protein and the adoption of the correct conformation for said fusion protein activity and which does not alter the specificity of either of the monomers for their targets. Peptide linkers can be of various sizes, from 3 amino acids to 50 amino acids as a non limiting indicative range. Peptide linkers can also be structured or unstructured.

by "related to", particularly in the expression "one cell type related to the chosen cell type or organism", is intended a cell type or an organism sharing characteristics with said chosen cell type or said chosen organism; this cell type or organism related to the chosen cell type or organism, can be derived from said chosen cell type or organism or not.

by "subdomain" it is intended the region of a LAGLIDADG homing endonuclease core domain which interacts with a distinct part of a homing endonuclease DNA target half-site.

by "targeting DNA construct/minimal repair matrix/repair matrix" it is intended to mean a DNA construct comprising a first and second portion that are homologous to regions 5' and 3' of the DNA target in situ. The DNA construct also comprises a third portion positioned between the first and second portion which comprise some homology with the corresponding DNA sequence in situ or alternatively comprise no homology with the regions 5' and 3' of the DNA target in situ. Following cleavage of the DNA target, a homologous recombination event is stimulated between the genome containing the targeted gene comprised in the locus of interest and the repair matrix, wherein the genomic sequence containing the DNA target is replaced by the third portion of the repair matrix and a variable part of the first and second portions of the repair matrix.

by "functional variant" is intended a catalytically active variant of a protein, such variant can have additional properties-compared to its parent protein. As a non-limiting example, a functional variant of a meganuclease can be able to cleave a DNA target sequence, preferably said target being a new target which is not cleaved by the parent meganuclease. This definition also applies to compact TALENs, enhanced compact TALENs, dual-cleavage compact TALENs or protein domains that constitute such TALENs according to the present invention. Are also encompassed in the scope of the present definition, functional variants, polypeptides and protein domains comprised in these molecules which present a sequence with high percentage of identity or high percentage of homology with sequences of compact TALENs, enhanced compact TALENs, dual-cleavage compact TALENs or protein domains and polypeptides according to the present invention, at nucleotidic or polypeptidic levels. By high percentage of identity or high percentage of homology it is intended 60%, more preferably 70%, more preferably 75%, more preferably 80%, more preferably 85%, more preferably 90%, more preferably 95, more preferably 97%, more preferably 99% or any integer comprised between 60% and 99%.

by "derived from" or "derivative(s)" it is intended to mean for instance a meganuclease variant which is created from a parent meganuclease and hence the peptide sequence of the meganuclease variant is related to (primary sequence level) but derived from (mutations) the peptide sequence of the parent meganuclease. In this definition, mutations encompass deletions or insertions of several amino acid residues; as non-limiting example, a truncated variant of an I-CreI meganuclease is considered as a scaffold derived from I-CreI meganuclease. This expression can also apply to compact TALENs, enhanced compact TALENs, dual-cleavage compact TALENs or protein domains that constitute such TALENs according to the present invention. Are also encompassed in the scope of the present definition, derivatives of compact TALENs, enhanced compact TALENs, dual-cleavage compact TALENs or protein domains and derivatives of polypeptides according to the present invention which present a sequence with high percentage of identity or high percentage of homology with sequences of compact TALENs, enhanced compact TALENs, dual-cleavage compact TALENs or protein domains and polypeptides according to the present invention, at nucleotidic or polypeptidic levels. By high percentage of identity or high percentage of homology it is intended 60%, more preferably 70%, more preferably 75%, more preferably 80%, more preferably 85%, more preferably 90%, more preferably 95, more preferably 97%, more preferably 99% or any integer comprised between 60% and 99%.

by "I-CreI" is intended the wild-type I-CreI having the sequence of pdb accession code 1g9y, corresponding to the sequence SEQ ID NO: 1 in the sequence listing. In the present Patent Application, I-CreI variants described can comprise an additional Alanine after the first Methionine of the wild type I-CreI sequence (SEQ ID NO: 1). These variants may also comprise two additional Alanine residues and an Aspartic Acid residue after the final Proline of the wild type I-CreI sequence as shown in SEQ ID NO: 106. These additional residues do not affect the properties of the enzyme and to avoid confusion these additional residues do not affect the numeration of the residues in I-CreI or a variant referred in the present Patent Application, as these references exclusively refer to residues of the wild type I-CreI enzyme (SEQ ID NO: 1) as present in the variant, so for instance residue 2 of I-CreI is in fact residue 3 of a variant which comprises an additional Alanine after the first Methionine.

by compact TALEN, enhanced compact TALEN, dual-cleavage compact TALEN with novel specificity is intended a variant of these proteins having a pattern of cleaved targets different from that of their respective parent compact TALENs, enhanced compact TALENs, dual-cleavage compact TALENs. The terms "novel specificity", "modified specificity", "novel cleavage specificity", "novel substrate specificity" which are equivalent and used indifferently, refer to the specificity of the variant towards the nucleotides of the DNA target sequence.

by "I-CreI site" is intended a 22 to 24 bp double-stranded DNA sequence which is cleaved by I-CreI. I-CreI sites include the wild-type non-palindromic I-CreI homing site and the derived palindromic sequences such as the sequence 5'-$t_{-12}c_{-11}a_{-10}a_{-9}a_{-8}a_{-7}c_{-6}g_{-5}t_{-4}c_{-3}g_{-2}t_{-1}a_{+1}c_{+2}g_{+3}a_{+4}c_{+5}g_{+6}t_{+7}t_{+8}t_{+10}g_{+11}a_{+12}$ (SEQ ID NO: 2), also called C1221 or C1221 target.

by "domain" or "core domain" is intended the "LAGLIDADG homing endonuclease core domain" which is the characteristic appappa fold of the homing endonucleases of the LAGLIDADG family, corresponding to a sequence of about one hundred amino acid residues. Said domain comprises four beta-strands ($\beta_1\beta_2\beta_3\beta_4$) folded in an anti-parallel beta-sheet which interacts with one half of the DNA target. This domain is able to associate with another LAGLIDADG homing endonuclease core domain which interacts with the other half of the DNA target to form a functional endonuclease able to cleave said DNA target. For example, in the case of the dimeric homing endonuclease I-CreI (163 amino acids), the LAGLIDADG homing endonuclease core domain corresponds to the residues 6 to 94.

by "beta-hairpin" is intended two consecutive beta-strands of the antiparallel beta-sheet of a LAGLIDADG homing endonuclease core domain ($\beta_3\beta_2$ or $\beta_3\beta_4$) which are connected by a loop or a turn.

by "single-chain meganuclease", "single-chain chimeric meganuclease", "single-chain meganuclease derivative", "single-chain chimeric meganuclease derivative" or "single-chain derivative" is intended a meganuclease comprising two LAGLIDADG homing endonuclease domains or core domains linked by a peptidic spacer.

The single-chain meganuclease is able to cleave a chimeric DNA target sequence comprising one different half of each parent meganuclease target sequence.

by "DNA target", "DNA target sequence", "target DNA sequence", "target sequence", "target-site", "target", "site", "site of interest", "recognition site", "polynucleotide recognition site", "recognition sequence", "homing recognition site", "homing site", "cleavage site" is intended a double-stranded palindromic, partially palindromic (pseudo-palindromic) or non-palindromic polynucleotide sequence that is recognized and can be cleaved by a LAGLIDADG homing endonuclease such as I-CreI, or a variant, or a single-chain chimeric meganuclease derived from I-CreI. Said DNA target sequence can be qualified as "cleavable" by an endonuclease, rare-cutting endonuclease, chimeric rare-cutting endonuclease or meganuclease when recognized within a genomic sequence and known to correspond to the DNA target sequence of a given endonuclease, rare-cutting endonuclease, chimeric rare-cutting endonuclease or meganuclease or a variant of such endonuclease, rare-cutting endonuclease, chimeric rare-cutting endonuclease or meganuclease. These terms refer to a specific DNA location, preferably a genomic location, but also a portion of genetic material that can exist independently to the main body of genetic material such as plasmids, episomes, virus, transposons or in organelles such as mitochondria or chloroplasts as non-limiting examples, at which a double stranded break (cleavage) can be induced by the endonuclease, rare-cutting endonuclease, chimeric rare-cutting endonuclease or meganuclease. For the LAGLIDADG subfamily of rare-cutting endonucleases, the DNA target is defined by the 5' to 3' sequence of one strand of the double-stranded polynucleotide, as indicate above for C1221 (SEQ ID NO: 2). Cleavage of the DNA target can occur at the nucleotides at positions +2 and −2, respectively for the sense and the antisense strand. Unless otherwise indicated, the position at which cleavage of the DNA target by an I-CreI-derived variant can occur, corresponds to the cleavage site on the sense strand of the DNA target. In the particular case of compact TALENs, a subclass of chimeric rare-cutting endonucleases, the following expressions "DNA target", "DNA target sequence", "target DNA sequence", "target sequence", "target-site", "target", "site", "site of interest", "recognition site", "polynucleotide recognition site", and "recognition sequence" can apply to qualify their specific DNA target sequence with the particularity that said specific DNA target sequence recognized by the compact TALEN according to the invention is the one or not that is processed and/or cut by the compact TALEN. A compact TALEN, an enhanced compact TALEN or a dual cleavage compact TALEN according to the present invention can process and/or cut DNA within said specific DNA target sequence. A compact TALEN, an enhanced compact TALEN or a dual cleavage compact TALEN can also process and/or cut DNA outside said specific DNA target sequence.

By "DNA nearby said specific DNA target sequence" or by "DNA nearby" is intended DNA sequence or sequences located within or outside said specific DNA target sequence. Are also intended DNA sequence or sequences bound by a compact TALEN or an enhanced compact TALEN at said specific DNA target sequence location or DNA located at a 5' or 3' distance of 1-100 base pairs (bps), 1-50 base pairs (bps) or 1-25 base pairs (bps) from said specific DNA target sequence.

When several compact TALENs have to be used in a particular genome engineering application, DNA target sequence for each compact TALENs of the combination to be used can be located on a same endogenous genomic DNA locus of interest or not. Said DNA target sequences can be located at an approximative distance of 1-1000 base pairs (bps), more preferably 1-500 bps, more preferably 1-100 bps, more preferably 1-100 bps, more preferably 1-50 bps, more preferably 1-25 bps, more preferably 1-10 bps. In another embodiment; said DNA target sequence for each compact TALENs of the combination to be used can be located on the same DNA strand or not. Said DNA target sequences located at distances mentioned above are "nearby" DNA sequences in reference to the target DNA sequence for DNA processing according to the present invention.

by "single double-stranded DNA target sequence" is intended a compact-TALEN or enhanced compact TALEN or dual-cleavage compact TALEN binding site. The recognition DNA binding site of a compact-TALEN or enhanced compact TALEN or dual-cleavage compact TALEN can be ranging from 12 to 100 base pairs (bp) in length, usually greater than 12 bps in length.

by "DNA target half-site", "half cleavage site" or half-site" is intended the portion of the DNA target which is bound by each LAGLIDADG homing endonuclease core domain.

The term "endonuclease" refers to any wild-type or variant enzyme capable of catalyzing the hydrolysis (cleavage) of bonds between nucleic acids within a DNA or RNA molecule, preferably a DNA molecule. Endonucleases can be classified as rare-cutting endonucleases when having typically a polynucleotide recognition greater than 12 base pairs (bp) in length, more preferably of 14-45 bp. Rare-cutting endonucleases significantly increase HR by inducing DNA double-strand breaks (DSBs) at a defined locus (Rouet, Smih et al. 1994; Rouet, Smih et al. 1994; Choulika, Perrin et al. 1995; Pingoud and Silva 2007). Rare-cutting endonucleases can for example be a homing endonuclease (Paques and Duchateau 2007), a chimeric Zinc-Finger nuclease (ZFN) resulting from the fusion of engineered zinc-finger domains with the catalytic domain of a restriction enzyme such as FokI (Porteus and Carroll 2005) or a chemical endonuclease (Eisenschmidt, Lanio et al. 2005; Arimondo, Thomas et al. 2006; Simon, Cannata et al. 2008). In chemical endonucleases, a chemical or peptidic cleaver is conjugated either to a polymer of nucleic acids or to another DNA recognizing a specific target sequence, thereby targeting the cleavage activity to a specific sequence. Chemical endonucleases also encompass synthetic nucleases like conjugates of orthophenanthroline, a DNA cleaving molecule, and triplex-forming oligonucleotides (TFOs), known to bind specific DNA sequences (Kalish and Glazer 2005). Such chemical endonucleases are comprised in the term "endonuclease" according to the present invention.

Rare-cutting endonucleases can also be for example TALENs, a new class of chimeric nucleases using a FokI catalytic domain and a DNA binding domain derived from Transcription Activator Like Effector (TALE), a family of proteins used in the infection process by plant pathogens of the *Xanthomonas* genus (Boch, Scholze et al. 2009; Boch, Scholze et al. 2009; Moscou and Bogdanove 2009; Moscou and Bogdanove 2009; Christian, Cermak et al. 2010; Christian, Cermak et al. 2010; Li, Huang et al. 2010; Li, Huang et al. 2011). The functional layout of a FokI-based TALE-nuclease (TALEN) is essentially that of a ZFN, with the Zinc-finger DNA binding domain being replaced by the TALE domain. As such, DNA cleavage by a TALEN requires two DNA recognition regions flanking an unspecific central region. Rare-cutting endonucleases encompassed in the present invention can also be derived from TALENs. The authors of the present invention have developed a new type of TALENs that can be engineered to specifically recognize and process target DNA efficiently. These novel "compact TALENs" (cTALENs) do not require dimerization for DNA processing activity, thereby alleviating the need for "dual" target sites with intervening DNA "spacers"; these compact TALENs can be seen as one subclass of rare-cutting endonucleases or chimeric rare-cutting endonucleases according to the present invention.

Rare-cutting endonuclease can be a homing endonuclease, also known under the name of meganuclease. Such homing endonucleases are well-known to the art (Stoddard 2005). Homing endonucleases recognize a DNA target sequence and generate a single- or double-strand break. Homing endonucleases are highly specific, recognizing DNA target sites ranging from 12 to 45 base pairs (bp) in length, usually ranging from 14 to 40 bp in length. The homing endonuclease according to the invention may for example correspond to a LAGLIDADG endonuclease, to a HNH endonuclease, or to a GIY-YIG endonuclease.

In the wild, meganucleases are essentially represented by homing endonucleases. Homing Endonucleases (HEs) are a widespread family of natural meganucleases including hundreds of proteins families (Chevalier and Stoddard 2001). These proteins are encoded by mobile genetic elements which propagate by a process called "homing": the endonuclease cleaves a cognate allele from which the mobile element is absent, thereby stimulating a homologous recombination event that duplicates the mobile DNA into the recipient locus. Given their exceptional cleavage properties in terms of efficacy and specificity, they could represent ideal scaffolds to derive novel, highly specific endonucleases.

HEs belong to four major families. The LAGLIDADG family, named after a conserved peptidic motif involved in the catalytic center, is the most widespread and the best characterized group. Seven structures are now available. Whereas most proteins from this family are monomeric and display two LAGLIDADG motifs, a few have only one motif, and thus dimerize to cleave palindromic or pseudo-palindromic target sequences.

Although the LAGLIDADG peptide is the only conserved region among members of the family, these proteins share a very similar architecture. The catalytic core is flanked by two DNA-binding domains with a perfect two-fold symmetry for homodimers such as I-CreI (Chevalier, Monnat et al. 2001), I-MsoI (Chevalier, Turmel et al. 2003) and I-CeuI (Spiegel, Chevalier et al. 2006) and with a pseudo symmetry for monomers such as I-SceI (Moure, Gimble et al. 2003), I-DmoI (Silva, Dalgaard et al. 1999) or I-AniI (Bolduc, Spiegel et al. 2003). Both monomers and both domains (for monomeric proteins) contribute to the catalytic core, organized around divalent cations. Just above the catalytic core, the two LAGLIDADG peptides also play an essential role in the dimerization interface. DNA binding depends on two typical saddle-shaped $\alpha\beta\beta\alpha\beta\beta\alpha$ folds, sitting on the DNA major groove. Other domains can be found, for example in inteins such as PI-PfuI (Ichiyanagi, Ishino et al. 2000) and PI-SceI (Moure, Gimble et al. 2002), whose protein splicing domain is also involved in DNA binding.

The making of functional chimeric meganucleases, by fusing the N-terminal I-DmoI domain with an I-CreI monomer (Chevalier, Kortemme et al. 2002; Epinat, Arnould et al. 2003); International PCT Application WO 03/078619 (Cellectis) and WO 2004/031346 (Fred Hutchinson Cancer Research Center, Stoddard et al)) have demonstrated the plasticity of LAGLIDADG proteins.

Different groups have also used a semi-rational approach to locally alter the specificity of the I-CreI (Seligman, Stephens et al. 1997; Sussman, Chadsey et al. 2004); International PCT Applications WO 2006/097784, WO 2006/097853, WO 2007/060495 and WO 2007/049156 (Cellectis); (Arnould, Chames et al. 2006; Rosen, Morrison et al. 2006; Smith, Grizot et al. 2006), I-SceI (Doyon, Pattanayak et al. 2006), PI-SceI (Gimble, Moure et al. 2003) and I-MsoI (Ashworth, Havranek et al. 2006).

In addition, hundreds of I-CreI derivatives with locally altered specificity were engineered by combining the semi-rational approach and High Throughput Screening:

Residues Q44, R68 and R70 or Q44, R68, D75 and I77 of I-CreI were mutagenized and a collection of variants with altered specificity at positions ±3 to 5 of the DNA target (5NNN DNA target) were identified by screening (International PCT Applications WO 2006/097784 and WO 2006/097853 (Cellectis); (Arnould, Chames et al. 2006; Smith, Grizot et al. 2006).

Residues K28, N30 and Q38 or N30, Y33 and Q38 or K28, Y33, Q38 and S40 of I-CreI were mutagenized and a collection of variants with altered specificity at positions ±8 to 10 of the DNA target (10NNN DNA target) were identified by screening (Arnould, Chames et al. 2006; Smith, Grizot et al. 2006); International PCT Applications WO 2007/060495 and WO 2007/049156 (Cellectis)).

Two different variants were combined and assembled in a functional heterodimeric endonuclease able to cleave a chimeric target resulting from the fusion of two different halves of each variant DNA target sequence ((Arnould, Chames et al. 2006; Smith, Grizot et al. 2006); International PCT Applications WO 2006/097854 and WO 2007/034262).

Furthermore, residues 28 to 40 and 44 to 77 of I-CreI were shown to form two partially separable functional subdomains, able to bind distinct parts of a homing endonuclease target half-site (Smith, Grizot et al. 2006); International PCT Applications WO 2007/049095 and WO 2007/057781 (Cellectis)).

The combination of mutations from the two subdomains of I-CreI within the same monomer allowed the design of novel chimeric molecules (homodimers) able to cleave a palindromic combined DNA target sequence comprising the nucleotides at positions ±3 to 5 and ±8 to 10 which are bound by each subdomain ((Smith, Grizot et al. 2006); International PCT Applications WO 2007/049095 and WO 2007/057781 (Cellectis)).

The method for producing meganuclease variants and the assays based on cleavage-induced recombination in mammal or yeast cells, which are used for screening variants with altered specificity are described in the International PCT Application WO 2004/067736; (Epinat, Arnould et al. 2003; Chames, Epinat et al. 2005; Arnould, Chames et al. 2006). These assays result in a functional LacZ reporter gene which can be monitored by standard methods.

The combination of the two former steps allows a larger combinatorial approach, involving four different subdomains. The different subdomains can be modified separately and combined to obtain an entirely redesigned meganuclease variant (heterodimer or single-chain molecule) with chosen specificity. In a first step, couples of novel meganucleases are combined in new molecules ("half-meganucleases") cleaving palindromic targets derived from the target one wants to cleave. Then, the combination of such "half-meganucleases" can result in a heterodimeric species cleaving the target of interest. The assembly of four sets of mutations into heterodimeric endonucleases cleaving a model target sequence or a sequence from different genes has been described in the following Cellectis International patent applications: XPC gene (WO2007/093918), RAG gene (WO2008/010093), HPRT gene (WO2008/059382), beta-2 microglobulin gene (WO2008/102274), Rosa26 gene (WO2008/152523), Human hemoglobin beta gene (WO2009/13622) and Human interleukin-2 receptor gamma chain gene (WO2009019614).

These variants can be used to cleave genuine chromosomal sequences and have paved the way for novel perspectives in several fields, including gene therapy.

Examples of such endonuclease include I-Sce I, I-Chu I, I-Cre I, I-Csm I, PI-Sce I, PI-Tli I, PI-Mtu I, I-Ceu I, I-Sce II, I-Sce III, HO, PI-Civ I, PI-Ctr I, PI-Aae I, PI-Bsu I, PI-Dha I, PI-Dra I, PI-Mav I, PI-Mch I, PI-Mfu I, PI-Mfl I, PI-Mga I, PI-Mgo I, PI-Min I, PI-Mka I, PI-Mle I, PI-Mma I, PI-Msh I, PI-Msm I, PI-Mth I, PI-Mtu I, PI-Mxe I, PI-Npu I, PI-Pfu I, PI-Rma I, PI-Spb I, PI-Ssp I, PI-Fac I, PI-Mja I, PI-Pho I, PI-Tag I, PI-Thy I, PI-Tko I, PI-Tsp I, I-MsoI.

A homing endonuclease can be a LAGLIDADG endonuclease such as I-SceI, I-CreI, I-CeuI, I-MsoI, and I-DmoI.

Said LAGLIDADG endonuclease can be I-Sce I, a member of the family that contains two LAGLIDADG motifs and functions as a monomer, its molecular mass being approximately twice the mass of other family members like I-CreI which contains only one LAGLIDADG motif and functions as homodimers.

Endonucleases mentioned in the present application encompass both wild-type (naturally-occurring) and variant endonucleases. Endonucleases according to the invention can be a "variant" endonuclease, i.e. an endonuclease that does not naturally exist in nature and that is obtained by genetic engineering or by random mutagenesis, i.e. an engineered endonuclease. This variant endonuclease can for example be obtained by substitution of at least one residue in the amino acid sequence of a wild-type, naturally-occurring, endonuclease with a different amino acid. Said substitution(s) can for example be introduced by site-directed mutagenesis and/or by random mutagenesis. In the frame of the present invention, such variant endonucleases remain functional, i.e. they retain the capacity of recognizing (binding function) and optionally specifically cleaving a target sequence to initiate gene targeting process.

The variant endonuclease according to the invention cleaves a target sequence that is different from the target sequence of the corresponding wild-type endonuclease. Methods for obtaining such variant endonucleases with novel specificities are well-known in the art.

Endonucleases variants may be homodimers (meganuclease comprising two identical monomers) or heterodimers (meganuclease comprising two non-identical monomers). It is understood that the scope of the present invention also encompasses endonuclease variants per se, including heterodimers (WO2006097854), obligate heterodimers (WO2008093249) and single chain meganucleases (WO03078619 and WO2009095793) as non limiting examples, able to cleave one target of interest in a polynucleotidic sequence or in a genome. The invention also encompasses hybrid variant per se composed of two monomers from different origins (WO03078619).

Endonucleases with novel specificities can be used in the method according to the present invention for gene targeting and thereby integrating a transgene of interest into a genome at a predetermined location.

by "parent meganuclease" it is intended to mean a wild type meganuclease or a variant of such a wild type meganuclease with identical properties or alternatively a meganuclease with some altered characteristics in comparison to a wild type version of the same meganuclease. This expression can also be transposed to an endonuclease, a rare-cutting endonuclease, a chimeric rare-cutting endonuclease, a TALEN or a compact TALEN and derivatives.

By "delivery vector" or "delivery vectors" is intended any delivery vector which can be used in the present invention to put into cell contact (i.e "contacting") or deliver inside cells or subcellular compartments agents/chemicals and molecules (proteins or nucleic acids) needed in the present invention. It includes, but is not limited to liposomal delivery vectors, viral delivery vectors, drug delivery vectors, chemical carriers, polymeric carriers, lipoplexes, polyplexes, dendrimers, microbubbles (ultrasound contrast agents), nanoparticles, emulsions or other appropriate transfer vectors. These delivery vectors allow delivery of molecules, chemicals, macromolecules (genes, proteins), or other vectors such as plasmids, peptides developed by Diatos. In these cases, delivery vectors are molecule carriers. By "delivery vector" or "delivery vectors" is also intended delivery methods to perform transfection.

The terms "vector" or "vectors" refer to a nucleic acid molecule capable of transporting another nucleic acid to which it has been linked. A "vector" in the present invention includes, but is not limited to, a viral vector, a plasmid, a RNA vector or a linear or circular DNA or RNA molecule which may consists of a chromosomal, non chromosomal, semi-synthetic or synthetic nucleic acids. Preferred vectors are those capable of autonomous replication (episomal vector) and/or expression of nucleic acids to which they are linked (expression vectors). Large numbers of suitable vectors are known to those of skill in the art and commercially available.

Viral vectors include retrovirus, adenovirus, parvovirus (e. g. adenoassociated viruses), coronavirus, negative strand RNA viruses such as orthomyxovirus (e. g., influenza virus), rhabdovirus (e. g., rabies and vesicular stomatitis virus), paramyxovirus (e. g. measles and Sendai), positive strand RNA viruses such as picornavirus and alphavirus, and double-stranded DNA viruses including adenovirus, herpesvirus (e. g., Herpes Simplex virus types 1 and 2, Epstein-Barr virus, cytomegalovirus), and poxvirus (e. g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

By "lentiviral vector" is meant HIV-Based lentiviral vectors that are very promising for gene delivery because of their relatively large packaging capacity, reduced immunogenicity and their ability to stably transduce with high efficiency a large range of different cell types. Lentiviral vectors are usually generated following transient transfection of three (packaging, envelope and transfer) or more plasmids into producer cells. Like HIV, lentiviral vectors enter the target cell through the interaction of viral surface glycoproteins with receptors on the cell surface. On entry; the viral RNA undergoes reverse transcription, which is mediated by the viral reverse transcriptase complex. The product of reverse transcription is a double-stranded linear viral DNA, which is the substrate for viral integration in the DNA of infected cells.

By "integrative lentiviral vectors (or LV)", is meant such vectors as non limiting example, that are able to integrate the genome of a target cell.

At the opposite by "non integrative lentiviral vectors (or NILV)" is meant efficient gene delivery vectors that do not integrate the genome of a target cell through the action of the virus integrase.

One type of preferred vector is an episome, i.e., a nucleic acid capable of extra-chromosomal replication. Preferred vectors are those capable of autonomous replication and/or expression of nucleic acids to which they are linked. Vectors capable of directing the expression of genes to which they are operatively linked are referred to herein as "expression vectors. A vector according to the present invention comprises; but is not limited to, a YAC (yeast artificial chromosome), a BAC (bacterial artificial), a baculovirus vector, a phage, a phagemid, a cosmid, a viral vector, a plasmid, a RNA vector or a linear or circular DNA or RNA molecule which may consist of chromosomal, non chromosomal, semi-synthetic or synthetic DNA. In general, expression vectors of utility in recombinant DNA techniques are often in the form of "plasmids" which refer generally to circular double stranded DNA loops which, in their vector form are not bound to the chromosome. Large numbers of suitable vectors are known to those of skill in the art. Vectors can comprise selectable markers, for example: neomycin phosphotransferase, histidinol dehydrogenase, dihydrofolate reductase, hygromycin phosphotransferase, herpes simplex virus thymidine kinase, adenosine deaminase, glutamine synthetase, and hypoxanthine-guanine phosphoribosyl transferase for eukaryotic cell culture; TRP1 for *S. cerevisiae*; tetracyclin, rifampicin or ampicillin resistance in *E. coli*. Preferably said vectors are expression vectors, wherein a sequence encoding a polypeptide of interest is placed under control of appropriate transcriptional and translational control elements to permit production or synthesis of said polypeptide. Therefore, said polynucleotide is comprised in an expression cassette. More particularly, the vector comprises a replication origin, a promoter operatively linked to said encoding polynucleotide, a ribosome binding site, a RNA-splicing site (when genomic DNA is used), a polyadenylation site and a transcription termination site. It also can comprise an enhancer or silencer elements. Selection of the promoter will depend upon the cell in which the polypeptide is expressed. Suitable promoters include tissue specific and/or inducible promoters. Examples of inducible promoters are: eukaryotic metallothionine promoter which is induced by increased levels of heavy metals, prokaryotic lacZ promoter which is induced in response to isopropyl-β-D-thiogalacto-pyranoside (IPTG) and eukaryotic heat shock promoter which is induced by increased temperature. Examples of tissue specific promoters are skeletal muscle creatine kinase, prostate-specific antigen (PSA), α-antitrypsin protease, human surfactant (SP) A and B proteins, β-casein and acidic whey protein genes.

Inducible promoters may be induced by pathogens or stress, more preferably by stress like cold, heat, UV light, or high ionic concentrations (reviewed in Potenza C et al. 2004, In vitro Cell Dev Biol 40:1-22). Inducible promoter may be induced by chemicals (reviewed in (Moore, Samalova et al. 2006); (Padidam 2003); (Wang, Zhou et al. 2003); (Zuo and Chua 2000).

Delivery vectors and vectors can be associated or combined with any cellular permeabilization techniques such as sonoporation or electroporation or derivatives of these techniques.

By cell or cells is intended any prokaryotic or eukaryotic living cells, cell lines derived from these organisms for in vitro cultures, primary cells from animal or plant origin.

By "primary cell" or "primary cells" are intended cells taken directly from living tissue (i.e. biopsy material) and, astablished for growth in vitro, that have undergone very few population doublings and are therefore more representative of the main functional components and characteristics of tissues from which they are derived from, in comparison to continuous tumorigenic or artificially immortalized cell lines. These cells thus represent a more valuable model to the in vivo state they refer to.

In the frame of the present invention, "eukaryotic cells" refer to a fungal, plant or animal cell or a cell line derived from the organisms listed below and established for in vitro culture. More preferably, the fungus is of the genus *Aspergillus, Penicillium, Acremonium, Trichoderma, Chrysoporium, Mortierella, Kluyveromyces* or *Pichia*; More preferably, the fungus is of the species *Aspergillus niger, Aspergillus nidulans, Aspergillus oryzae, Aspergillus terreus, Penicillium chrysogenum, Penicillium citrinum, Acremonium chrysogenum, Trichoderma reesei, Mortierella alpine, Chrysosporium lucknowense, Kluyveromyces lactis, Pichia pastoris* or *Pichia ciferrii*.

More preferably the plant is of the genus *Arabidopsis, Nicotiana, Solanum, lactuca, Brassica, Oryza, Asparagus, Pisum, Medicago, Zea, Hordeum, Secale, Triticum, Capsicum, Cucumis, Cucurbita, Citrullis, Citrus, Sorghum*; More preferably, the plant is of the species *Arabidopsis thaliana, Nicotiana tabaccum, Solanum lycopersicum, Solanum tuberosum, Solanum melongena, Solanum esculentum, Lactuca saliva, Brassica napus, Brassica oleracea, Brassica rapa, Oryza glaberrima, Oryza sativa, Asparagus officinalis, Pisum sativum, Medicago sativa, Zea mays, Hordeum vulgare, Secale cereal, Triticum aestivum, Triticum durum, Capsicum sativus, Cucurbita pepo, Citrullus lanatus, Cucumis melo, Citrus aurantifolia, Citrus maxima, Citrus medica, Citrus reticulata*.

More preferably the animal cell is of the genus *Homo, Rattus, Mus, Sus, Bos, Danio, Canis, Felis, Equus, Salmo, Oncorhynchus, Gallus, Meleagris, Drosophila, Caenorhabditis*; more preferably, the animal cell is of the species *Homo sapiens, Rattus norvegicus, Mus musculus, Sus scrofa, Bos taurus, Danio rerio, Canis lupus, Felis catus, Equus caballus, Salmo salar, Oncorhynchus mykiss, Gallus gallus, Meleagris gallopavo, Drosophila melanogaster, Caenorhabditis elegans*.

In the present invention, the cell can be a plant cell, a mammalian cell, a fish cell, an insect cell or cell lines derived from these organisms for in vitro cultures or primary cells taken directly from living tissue and established for in vitro culture. As non-limiting examples, cell can be protoplasts obtained from plant organisms listed above. As non limiting examples cell lines can be selected from the group consisting of CHO-K1 cells; HEK293 cells; Caco2 cells; U2-OS cells; NIH 3T3 cells; NSO cells; SP2 cells; CHO-S cells; DG44 cells; K-562 cells, U-937 cells; MRC5 cells; IMR90 cells; Jurkat cells; HepG2 cells; HeLa cells; HT-1080 cells; HCT-116 cells; Hu-h7 cells; Huvec cells; Molt 4 cells.

All these cell lines can be modified by the method of the present invention to provide cell line models to produce, express, quantify, detect, study a gene or a protein of interest; these models can also be used to screen biologically active molecules of interest in research and production and various fields such as chemical, biofuels, therapeutics and agronomy as non-limiting examples. Adoptive immunotherapy using genetically engineered T cells is a promising approach for the treatment of malignancies and infectious diseases. Most current approaches rely on gene transfer by random integration of an appropriate T Cell Receptor (TCR) or Chimeric Antigen Receptor (CAR). Targeted approach using rare-cutting endonucleases is an efficient and safe alternative method to transfer genes into T cells and generate genetically engineered T cells.

- by "homologous" is intended a sequence with enough identity to another one to lead to homologous recombination between sequences, more particularly having at least 95% identity, preferably 97% identity and more preferably 99%.
- "identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting.
- by "mutation" is intended the substitution, deletion, insertion of one or more nucleotides/amino acids in a polynucleotide (cDNA, gene) or a polypeptide sequence. Said mutation can affect the coding sequence of a gene or its regulatory sequence. It may also affect the structure of the genomic sequence or the structure/stability of the encoded mRNA.
- In the frame of the present invention, the expression "double-strand break-induced mutagenesis" (DSB-induced mutagenesis) refers to a mutagenesis event consecutive to an NHEJ event following an endonuclease-induced DSB, leading to insertion/deletion at the cleavage site of an endonuclease.
- By "gene" is meant the basic unit of heredity, consisting of a segment of DNA arranged in a linear manner along a chromosome, which codes for a specific protein or segment of protein. A gene typically includes a promoter, a 5' untranslated region, one or more coding sequences (exons), optionally introns, a 3' untranslated region. The gene may further comprise a terminator, enhancers and/or silencers.
- As used herein, the term "transgene" refers to a sequence encoding a polypeptide. Preferably, the polypeptide encoded by the transgene is either not expressed, or expressed but not biologically active, in the cell, tissue or individual in which the transgene is inserted. Most preferably, the transgene encodes a therapeutic polypeptide useful for the treatment of an individual.
- The term "gene of interest" or "GO" refers to any nucleotide sequence encoding a known or putative gene product.
- As used herein, the term "locus" is the specific physical location of a DNA sequence (e.g. of a gene) on a chromosome. The term "locus" usually refers to the specific physical location of an endonuclease's target sequence on a chromosome. Such a locus, which comprises a target sequence that is recognized and cleaved by an endonuclease according to the invention, is referred to as "locus according to the invention". Also, the expression "genomic locus of interest" is used to qualify a nucleic acid sequence in a genome that can be a putative target for a double-strand break according to the invention. It is understood that the considered genomic locus of interest of the present invention can not only qualify a nucleic acid sequence that exists in the main body of genetic material (i.e. in a chromosome) of a cell but also a portion of genetic material that can exist independently to said main body of genetic material such as plasmids, episomes, virus, transposons or in organelles such as mitochondria or chloroplasts as non-limiting examples.
- By the expression "loss of genetic information" is understood the elimination or addition of at least one given DNA fragment (at least one nucleotide) or sequence, bordering the recognition sites of the endonucleases, chimeric rare-cutting endonucleases, compact TALEN or enhanced compact TALEN of the present invention or the intervening sequence between at least two processing sites of the endonucleases, chimeric rare-cutting endonucleases, compact TALEN or enhanced compact TALEN of the present invention and leading to a change of the original sequence around said endonuclease-cutting sites, chimeric rare-cutting endonuclease-cutting sites, compact TALEN or enhanced compact TALEN recognition DNA binding site within the genomic locus of interest. This loss of genetic information can be, as a non-limiting example, the elimination of an intervening sequence between two endonuclease-cutting sites or between two processing sites of a compact TALEN or enhanced compact TALEN. As another non-limiting example, the loss of genetic information can also be an excision of a single-strand of DNA spanning the binding region of a compact TALEN or an enhanced compact TALEN according to the present invention
- By "scarless re-ligation" or "scarless religation" is intended the perfect re-ligation event, without loss of genetic information (no insertion/deletion events) of the DNA broken ends through NHEJ process after the creation of a double-strand break event.
- By "Imprecise NHEJ" is intended the re-ligation of nucleic acid ends generated by a DSB, with insertions or deletions of nucleotides. Imprecise NHEJ is an outcome and not a repair pathway and can result from different NHEJ pathways (Ku dependent or Ku independent as non-limiting examples).
- By "fusion protein" is intended the result of a well-known process in the art consisting in the joining of two or more genes which originally encode for separate proteins or part of them, the translation of said "fusion gene" resulting in a single polypeptide with functional properties derived from each of the original proteins.

By "chimeric rare-cutting endonuclease" is meant any fusion protein comprising a rare-cutting endonuclease. Said rare-cutting endonuclease might be at the N-terminal part of said chimeric rare-cutting endonuclease; at the opposite, said rare-cutting endonuclease might be at the C-terminal part of said chimeric rare-cutting endonuclease. A "chimeric rare-cutting endonuclease" according to the present invention which comprises two catalytic domains can be described as "bi-functional" or as "bi-functional meganuclease". A "chimeric rare-cutting endonuclease" according to the present inventions which comprises more than two catalytic domains can be described as "multi-functional" or as "multi-functional meganuclease". As non-limiting examples, chimeric rare-cutting endonucleases according to the present invention can be a fusion protein between a rare-cutting endonuclease and one catalytic domain; chimeric rare-cutting endonucleases according to the present invention can also be a fusion protein between a rare-cutting endonuclease and two catalytic domains. As mentioned previously, the rare-cutting endonuclease part of chimeric rare-cutting endonucleases according to the present invention can be a meganuclease comprising two identical monomers, two non-identical monomers, or a single chain meganuclease. The rare-cutting endonuclease part of chimeric rare-cutting endonucleases according to the present invention can also be the DNA-binding domain of an inactive rare-cutting endonuclease. In other non-limiting examples, chimeric rare-cutting endonucleases according to the present invention can be derived from a TALE-nuclease (TALEN), i. e. a fusion between a DNA-binding domain derived from a Transcription Activator Like Effector (TALE) and one or two catalytic domains. In other non-limiting examples, a subclass of chimeric rare-cutting endonucleases according to the present invention can be a "compact TALE-nuclease" (cTALEN), i. e. a fusion between an engineered core TALE scaffold comprising at least a Repeat Variable Dipeptide regions domain and at least one catalytic domain, said fusion protein constituting a compact TALEN active entity that does not require dimerization for DNA processing activity. Said catalytic domain an be an endonuclease as listed in table 2 as non-limiting examples; said catalytic domain can be a frequent-cutting endonuclease such as a restriction enzyme selected from the group consisting of MmeI, R-HinPII, R.MspI, R.MvaI, Nb.BsrDI, BsrDI A, Nt.BspD6I, ss.BspD6I, R.PleI, MlyI and AlwI as non-limiting restriction enzymes examples listed in table 2.

By "enhancer domain(s)" or "enhancer(s)" are meant protein domains that provide functional and/or structural support to a protein scaffold, a compact TALEN as a non-limiting example, therefore allowing an enhancement in global DNA processing efficiency of the resulting fusion protein, i.e an enhanced compact TALEN, relative to the DNA processing efficiency of the starting compact TALEN. A particular domain is an enhancer domain when it provides at least a 5% enhancement in efficiency of the starting scaffold, more preferably 10%, again more preferably 15%, again more preferably 20%, again more preferably 25%, again more preferably 50%, again more preferably greater than 50%. Non-limiting examples of such enhancer domains are given in Tables 1 and 2. By "auxiliary enhancer domains" or "auxiliary enhancers" or "auxiliary domains" are meant protein domains acting in trans with a compact TALEN or an enhanced compact TALEN to provide an additional function that is not essential for said basic compact TALEN activity or said enhanced compact TALEN activity. When such auxiliary enhancers are used, compact TALEN or enhanced compact TALEN are converted to "trans TALEN", respectively trans compact TALEN and trans enhanced compact TALEN.

By "catalytic domain" is intended the protein domain or module of an enzyme containing the active site of said enzyme; by active site is intended the part of said enzyme at which catalysis of the substrate occurs. Enzymes, but also their catalytic domains, are classified and named according to the reaction they catalyze. The Enzyme Commission number (EC number) is a numerical classification scheme for enzymes, based on the chemical reactions they catalyze (http://www.chem.qmul.ac.uk/iubmb/enzyme/). In the scope of the present invention, any catalytic domain can be fused to an engineered core TALE scaffold to generate a compact TALEN active entity with a DNA processing efficiency provided by at least said catalytic domain activity. Said catalytic domain can provide a nuclease activity (endonuclease or exonuclease activities, cleavase or nickase), a polymerase activity, a kinase activity, a phosphatase activity, a methylase activity, a topoisomerase activity, an integrase activity, a transposase activity or a ligase activity as non-limiting examples. Non-limiting examples of such catalytic domains are given in Tables 1 and 2. In a preferred embodiment of the present invention, said catalytic domain can be considered as an enhancer domain. If catalytically active, said enhancer domain can provide functional and/or structural support to the compact TALEN scaffold leading to an enhanced compact TALEN when fused to it. If catalytically inactive, said enhancer domain provides structural support to compact TALEN scaffold leading to an enhanced compact TALEN when fused to it. It can be envisioned from the present invention to fuse catalytic domains according to the present invention to one part of a classical TALEN in order to give these classical TALENs new catalytical properties provided by at least said catalytic domain activity or to improve their DNA processing efficiency.

By "nuclease catalytic domain" is intended the protein domain comprising the active site of an endonuclease or an exonuclease enzyme. Such nuclease catalytic domain can be, for instance, a "cleavase domain" or a "nickase domain". By "cleavase domain" is intended a protein domain whose catalytic activity generates a Double Strand Break (DSB) in a DNA target. By "nickase domain" is intended a protein domain whose catalytic activity generates a single strand break in a DNA target sequence. Non-limiting examples of such catalytic domains are given in Tables 1 and 2 with a GenBank or NCBI or UniProtKB/Swiss-Prot number as a reference.

By a "TALE-nuclease" (TALEN) or a "classical TALEN" is intended a fusion protein consisting of a DNA-binding domain derived from a Transcription Activator Like Effector (TALE) and one FokI catalytic domain, that need to dimerize to form an active entity able to cleave a DNA target sequence.

By "compact TALE-nuclease" (cTALEN) is intended a general designation according to the present invention for a fusion protein between an engineered core TALE scaffold comprising at least one Repeat Variable Dipeptides domain and at least one catalytic domain, said fusion protein constituting a compact TALEN (or cTALEN) active entity and not requiring dimerization for DNA processing activity. Compact TALENs are designed to alleviate the need for multiple independent protein moieties when targeting a DNA cleavage event: Importantly, the requisite "spacer" region and dual target sites essential for the function of current TALENs are unnecessary. In other words, the compact TALEN according to the present invention is an active entity unit able, by itself, to target only one specific single double-stranded DNA target sequence of interest through one DNA binding domain and to process DNA nearby said single double-stranded DNA target sequence of interest. In addition, since the catalytic domain does not require specific DNA contact, there are no restrictions on regions surrounding the core TALE DNA binding domain. In the scope of the present invention, it can be also envisioned some sequence preference in the catalytic domain. When a cTALEN comprises only one catalytic domain, cTALEN can be qualified as a "basic cTALEN" or "cTALEN". When a cTALEN further comprises at least one "enhancer domain", cTALEN can be qualified as an enhanced cTALEN or an "cTALEN". A cTALEN or an cTALEN that comprise at least one cleavase catalytic domain and one nickase catalytic domain or at least two cleavase catalytic domains can be specifically qualified as a dual-cleavage cTALEN or a "dcTALEN". A cTALEN or an cTALEN acting with an auxiliary domain in trans is qualified as a trans compact TALEN or a trans enhanced compact TALEN, both being "trans TALEN".

The above written description of the invention provides a manner and process of making and using it such that any person skilled in this art is enabled to make and use the same, this enablement being provided in particular for the subject matter of the appended claims, which make up a part of the original description.

As used above, the phrases "selected from the group consisting of," "chosen from," and the like include mixtures of the specified materials.

Where a numerical limit or range is stated herein, the endpoints are included. Also, all values and subranges within a numerical limit or range are specifically included as if explicitly written out.

The above description is presented to enable a person skilled in the art to make and use the invention, and is provided in the context of a particular application and its requirements. Various modifications to the preferred embodiments will be readily apparent to those skilled in the art, and the generic principles defined herein may be applied to other embodiments and applications without departing from the spirit and scope of the invention. Thus, this invention is not intended to be limited to the embodiments shown, but is to be accorded the widest scope consistent with the principles and features disclosed herein.

Having generally described this invention, a further understanding can be obtained by reference to certain specific examples, which are provided herein for purposes of illustration only, and are not intended to be limiting unless otherwise specified.

EXAMPLES

Example 1

The wild-type I-CreI meganuclease (SEQ ID NO: 106) was chosen as the parent scaffold on which to fuse the catalytic domain of I-TevI (SEQ ID NO: 107). Wild-type I-TevI functions as a monomeric cleavase of the GIY-YIG family to generate a staggered double-strand break in its target DNA. Guided by biochemical and structural data, variable length constructs were designed from the N-terminal region of I-TevI that encompass the entire catalytic domain and deletion-intolerant region of its linker (SEQ ID NO: 109 to SEQ ID NO: 114). In all but one case, fragments were fused to the N-terminus of I-CreI with an intervening 5-residue polypeptide linker (-QGPSG-; SEQ ID NO: 103). The linker-less fusion construct naturally contained residues (-LGPDGRKA-; SEQ ID NO: 104) similar to those in the artificial linker. As I-CreI is a homodimer, all fusion constructs contain three catalytic centers (FIG. 4, where "catalytic domain"=cleavase): the natural I-CreI active site at the interface of the dimer and one I-TevI active site per monomer.

The activity of each "tri-functional" meganuclease was assessed using our yeast assay previously described in International PCT Applications WO 2004/067736 and in (Epinat, Arnould et al. 2003; Chames, Epinat et al. 2005; Arnould, Chames et al. 2006; Smith, Grizot et al. 2006). All constructs were able to cleave the C1221 target DNA with an activity comparable to that of wild-type I-CreI (Table 4). To validate the activity of the I-TevI catalytic domain independent of the I-CreI catalytic core, D20N point mutants were made to inactivate the I-CreI scaffold [SEQ ID NO: 108, SEQ ID NO: 115 to SEQ ID NO: 120; Chevalier, Sussman et al. 2004)]. Tests in our yeast assays showed no visible activity from the inactivated I-CreI (D20N) mutant protein alone (Table 4). However, cleavage activity could be observed for fusions having the I-TevI catalytic domain (Table 4).

TABLE 4

Activity in Yeast assay for I-TevI-/I-CreI fusions. The relative activity of wild-type and fusion proteins on the two parent protein targets (C1221 for I-CreI and Tev for I-TevI) is shown. Maximal activity (++++) is seen with each given protein on its native DNA target. I-CreI_N20 is an inactive variant of the wild-type I-CreI scaffold. In all other cases, activity is only detected on the C1221 target since DNA recognition is driven by the I-CreI scaffold. The "N20" fusion variants illustrate cleavage activity due to the I-TevI catalytic domain.

| Protein Construct | Relative Activity in Yeast Assay (37° C.) | |
|---|---|---|
| | C1221 Target | Tev Target |
| I-CreI | ++++ | – |
| I-TevI | – | ++++ |
| I-CreI_N20 | – | – |
| hTevCre_D01 | ++++ | – |
| hTevCre_D02 | ++++ | – |
| hTevCre_D03 | ++++ | – |
| hTevCre_D04 | ++++ | – |
| hTevCre_D05 | ++++ | – |
| hTevCre_D06 | ++++ | – |
| hTevCre_D01_N20 | ++ | – |
| hTevCre_D02_N20 | ++ | – |
| hTevCre_D03_N20 | ++ | – |
| hTevCre_D04_N20 | ++ | – |
| hTevCre_D05_N20 | – | – |
| hTevCre_D06_N20 | – | – |

Relative activity is scaled as:
–, no activity detectable;
+, <25% activity;
++, 25% to <50% activity;
+++, 50% to <75% activity;
++++, 75% to 100% activity.

Example 2

Protein-fusion scaffolds were designed based on a truncated form of I-CreI (SEQ ID NO: 106, I-CreI_X: SEQ ID NO: 121) and three different linker polypeptides (NFS1=SEQ ID NO: 98; NFS2=SEQ ID NO: 99; CFS1=SEQ ID NO: 100) fused to either the N- or C-terminus of the protein. Structure models were generated in all cases, with the goal of designing a "baseline" fusion linker that would traverse the I-CreI parent scaffold surface with little to no effect on its DNA binding or cleavage activities. For the two N-terminal fusion scaffolds, the polypeptide spanning residues 2 to 153 of I-CreI was used, with a K82A mutation to allow for linker placement. The C-terminal fusion scaffold contains residues 2 to 155 of wild-type I-CreI. For both fusion scaffold types, the "free" end of the linker (i.e. onto which a polypeptide can be linked) is designed to be proximal to the DNA, as determined from models built using the I-CreI/DNA complex structures as a starting point (PDB Md: 1g9z). The two I-CreI N-terminal fusion scaffolds (I-CreI_NFS1=SEQ ID NO: 122 and I-CreI_NFS2=SEQ ID NO: 123) and the single C-terminal fusion scaffold (I-CreI_CFS1=SEQ ID NO: 124) were tested in our yeast assay (see Example 1) and found to have activity similar to that of wild-type I-CreI (Table 5).

TABLE 5

Activity in Yeast assay for ColE7/I-CreI fusions. The relative activity of wild-type and fusion proteins on the C1221target is shown. I-CreI_X represents a truncated version of I-CreI based on the crystal structure and was used as the foundation for the fusion scaffolds (I-CreI_NFS1, I-CreI_NFS2 and I-CreI_CFS1). "N20" constructs are inactive variants of the respective I-CreI-based scaffolds. Activity is detected in all cases wherein the I-CreI scaffold is active or when DNA catalysis is provided by the ColE7 domain.

| Protein Construct | Relative Activity in Yeast Assay (37° C.) C1221 Target |
|---|---|
| I-CreI | ++++ |
| I-CreI_X | ++++ |
| I-CreI_NFS1 | ++++ |
| I-CreI_NFS2 | ++++ |
| I-CreI_CFS1 | ++++ |
| I-CreI_NFS1_N20 | − |
| I-CreI_NFS2_N20 | − |
| I-CreI_CFS1_N20 | − |
| hColE7Cre_D0101 | ++++ |
| hColE7Cre_D0102 | ++++ |
| hCreColE7_D0101 | ++++ |
| hColE7Cre_D0101_N20 | +++ |
| hColE7Cre_D0102_N20 | +++ |
| hCreColE7_D0101_N20 | ++ |

Relative activity is scaled as:
−, no activity detectable;
+, <25% activity;
++, 25% to <50% activity;
+++, 50% to <75% activity;
++++, 75% to 100% activity.

Colicin E7 is a non-specific nuclease of the HNH family able to process single- and double-stranded DNA (Hsia, Chak et al. 2004). Guided by biochemical and structural data, the region of ColE7 that encompasses the entire catalytic domain (SEQ ID NO: 140; (Hsia, Chak et al. 2004) was selected. This ColE7 domain was fused to the N-terminus of either I-CreI_NFS1 (SEQ ID NO: 122) or I-CreI_NFS2 (SEQ ID NO: 123) to create hColE7Cre_D0101 (SEQ ID NO: 128) or hColE7Cre_D0102 (SEQ ID NO: 129), respectively. In addition, a C-terminal fusion construct, hCreColE7_D0101 (SEQ ID NO: 130), was generated using I-CreI_CFS1 (SEQ ID NO: 124). As I-CreI is a homodimer, all fusion constructs contain three catalytic centers (FIG. 4, where "catalytic domain"=cleavase): the natural I-CreI active site at the interface of the dimer and one ColE7 active site per monomer.

The activity of each "tri-functional" meganuclease was assessed using our yeast assay (see Example 1). All constructs were able to cleave the C1221 target DNA with an activity comparable to that of wild-type I-CreI (Table 5).

To validate the activity of the ColE7 catalytic domain independent of the I-CreI catalytic core, D20N point mutants were made to inactivate the I-CreI scaffold (SEQ ID NO: 125, SEQ ID NO: 126, SEQ ID NO: 127, SEQ ID NO: 131, SEQ ID NO: 132, SEQ ID NO: 133; (Chevalier, Sussman et al. 2004)). Tests in our yeast assays showed no visible activity from the inactivated I-CreI (D20N) mutant proteins alone (Table 5). However, cleavage activity could be observed for fusions having the ColE7 catalytic domain (Table 5).

Example 3

Two core TALE scaffolds are generated onto which (a) different sets of RVD domains could be inserted to change DNA binding specificity, and; (b) a selection of catalytic domains could be attached, N- or C-terminal, to effect DNA cleavage (or nicking). The core scaffolds (sT1: SEQ ID NO: 134 and sT2: SEQ ID NO: 135) differ in the N- and C-terminal regions, where sT2 is a truncated variant lacking 152 amino acid residues from the N-terminus (Szurek, Rossier et al. 2002) and the last 220 residues from the C-terminus compared to sT1. In sT1, the C-terminal region is a truncation with respect to wild-type TALE domains, ending at a fortuitously defined restriction site (BamHI) in the DNA coding sequence.

Using the two core scaffolds, four "baseline" TALE DNA binding proteins (bT1-Avr=SEQ ID NO: 136, bT2-Avr=SEQ ID NO: 137, bT1-Pth=SEQ ID NO 138 and bT2-Pth=SEQ ID NO 139) are generated by insertion of the corresponding set of repeat domains that recognize the naturally occurring asymmetric sequences AvrBs3 (19 bp) and PthXo1 (25 bp) (FIG. 3). Example protein sequences of the baseline scaffolds are listed in SEQ ID NO: 136 to SEQ ID NO: 139. As is, these scaffolds can be tested in vitro for DNA binding ability on targets having only a single recognition sequence. For comparison with existing TALENs, the catalytic domain of the FokI nuclease (SEQ ID NO: 368 and particularly residues P381 to F583 as non-limiting example) can be fused to either the N- or C-terminus of the baseline scaffolds. Effective cleavage using these controls requires target site DNAs that contain two TALE binding sequences.

In addition to verifying activity using naturally occurring sequences, five artificial RVD constructs recognizing relevant sequences were generated (FIG. 3): RagT2-R, NptIIT5-L, NptIIT5-R, NptIIT6-L, NptIIT6-R. Example protein sequences of the insert RVDs are listed in SEQ ID NO: 253 to SEQ ID NO: 257. Artificial RVD sequences are used as noted above within the sT1 or sT2 scaffold to generate the desired targeted compact TALENs.

Basic compact TALENs (cTALENs) are generated via fusion of catalytic domains to either the N- or C-terminus of the baseline scaffolds (FIG. 5, A or B, respectively). A non-exhaustive list of catalytic domains amenable to fusion with TALE DNA binding domains is presented in Table 2. A non-exhaustive list of linkers that can be used is presented in Table 3. It is notable that linker design can depend on the nature of the catalytic domain attached and its given application. It can also be anticipated that specially engineered linkers can be constructed to better control or regulate the activity of either or both domains. Examples 5, 6 and 7 below discuss additional and alternative methods in which linkers can be defined. All cTALEN designs are assessed using our yeast assay (see Example 1) and provide detectable activity comparable to existing engineered meganucleases.

Example 3a: TALE::TevI Compact TALEN

The catalytic domain of I-TevI (SEQ ID NO: 20), a member of the GIY-YIG endonuclease family, was fused to a TALE-derived scaffold (composed of a N-terminal domain, a central core composed of RVDs and a C-terminal domain) to create a new class of cTALEN (TALE::TevI). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "—RVD" optionally designates the sequence recognized by the TALE domain and "CD" is the catalytic domain type. Herein, we describe novel TALE::TevI constructions that target AvrBs3 sequence for example, thus named TALE-AvrBs3::TevI.

Activity of TALE::TevI in Yeast

A core TALE scaffold, sT2 (SEQ ID NO: 135), was selected onto which (a) different sets of RVD domains could be inserted to change DNA binding specificity, and; (b) a selection of I-TevI-derived catalytic domains could be attached, N- or C-terminal, to effect DNA cleavage (or nicking). The previously mentioned sT2 truncated scaffold was generated by the PCR from a full-length core TALEN scaffold template (pCLS7183, SEQ ID NO: 141) using primers CMP_G061 (SEQ ID NO: 142) and CMP_G065 (SEQ ID NO: 143) and was cloned into vector pCLS7865 (SEQ ID NO: 144) to generate pCLS7865-cTAL11_CFS1 (pCLS9009, SEQ ID NO: 145), where CFS1 designates the amino acid sequence -GSSG- (SEQ ID NO:468) (with underlying restriction sites BamHI and Kpn2I in the coding DNA to facilitate cloning). Three variants of the I-TevI (SEQ ID NO: 20) catalytic domain were amplified by the PCR on templates TevCreD01 [SEQ ID NO: 109 protein in plasmid pCLS6614 (SEQ ID NO: 146)] using the primer pair CMP_G069 (SEQ ID NO: 147) and CMP_G070 (SEQ ID NO: 148), TevCreD02 [SEQ ID NO: 110 protein in plasmid pCLS6615 (SEQ ID NO: 203)] using the primer pair CMP_G069 (SEQ ID NO: 147) and CMP_G071 (SEQ ID NO: 149) or TevCreD05 [SEQ ID NO: 113 protein in plasmid pCLS6618 SEQ ID NO: 258)] using the primer pair CMP_G069 (SEQ ID NO: 147) and CMP_G115 (SEQ ID NO: 259) and subcloned into the pCLS9009 backbone by restriction and ligation using BamHI and EagI restriction sites, yielding pCLS7865-cT11_TevD01 (pCLS9010, SEQ ID NO: 150), pCLS7865-cT11_TevD02 (pCLS9011, SEQ ID NO: 151) and pCLS7865-cT11_TevD05 (pCLS15775, SEQ ID NO: 260), respectively. All fusions contain the dipeptide -GS- linking the TALE-derived DNA binding domain and I-TevI-derived catalytic domain.

The DNA sequence coding for the RVDs to target the AvrBs3 site (SEQ ID NO: 152) was subcloned into both plasmids pCLS9010 (SEQ ID NO: 150, encoding the protein of SEQ ID NO: 420), pCLS9011 (SEQ ID NO: 151, encoding the protein of SEQ ID NO: 421) and pCLS15775 (SEQ ID NO: 260, encoding the protein of SEQ ID NO: 422) using Type IIS restriction enzymes BsmBI for the receiving plasmid and BbvI and SfaNI for the inserted RVD sequence to create the subsequent TALE-AvrBs3::TevI constructs cT11Avr_TevD01 (pCLS9012, SEQ ID NO: 218, encoding the protein of SEQ ID NO: 423), cT11Avr_TevD02 (pCLS9013, SEQ ID NO: 153, encoding the protein of SEQ ID NO: 424) and cT11Avr_TevD05 (pCLS15776, SEQ ID NO: 261, encoding the protein of SEQ ID NO: 425), respectively. These TALE-AvrBs3::TevI constructs were sequenced and the insert transferred to additional vectors as needed (see below).

The final TALE-AvrBs3::TevI yeast expression plasmids, pCLS8523 (SEQ ID NO: 154), pCLS8524 (SEQ ID NO: 155) and pCLS12092 (SEQ ID NO: 262), were prepared by yeast in vivo cloning using plasmids pCLS9012, pCLS9013 and pCLS15776, respectively. To generate an intact coding sequence by in vivo homologous recombination, approximately 40 ng of each plasmid linearized by digestion with BssHII and 1 ng of the pCLS0542 (SEQ ID NO: 156) plasmid DNA linearized by digestion with NcoI and EagI were used to transform, respectively, the yeast S. cerevisiae strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::TevI constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6). TALE-AvrBs3::TevI activity levels on their respective targets in yeast cells are shown on FIG. 9. Data summarized in FIG. 9 show that TALE-AvrBs3::TevI is active against several targets in Yeast.

Activity of TALE::TevI in Mammalian Cells DNA encoding the TALE-AvrBs3::TevI construct from either pCLS9012 (SEQ ID NO: 218) or pCLS9013 (SEQ ID NO: 153) was subcloned into the pCLS1853 (SEQ ID NO: 193) mammalian expression plasmid using AscI and XhoI restriction enzymes for the receiving plasmid and BssHII and XhoI restriction enzymes for the TALE-AvrBs3::TevI insert, leading to the mammalian expression plasmids pCLS8993 and pCLS8994 (SEQ ID NO: 194 and 195), respectively.

All mammalian target reporter plasmids containing the TALEN DNA target sequences, were constructed using the standard Gateway protocol (INVITROGEN) into a CHO reporter vector (Arnould, Chames et al. 2006, Grizot, Epinat et al. 2010). The TALE-AvrBs3::TevI constructs were tested in an extrachromosomal assay in mammalian cells (CHO K1) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6).

For this assay, CHO K1 cells were transfected in a 96-well plate format with 75 ng of target vector and an increasing quantity of each variant DNA from 0.7 to 25 ng, in the presence of PolyFect reagent (1 μL per well). The total amount of transfected DNA was completed to 125 ng (target DNA, variant DNA, carrier DNA) using an empty vector. Seventy-two hours after transfection, culture medium was removed and 150 µl of lysis/revelation buffer for β-galactosidase liquid assay was added. After incubation at 37° C., optical density was measured at 420 nm. The entire process is performed on an automated Velocity11 BioCel platform (Grizot, Epinat et al. 2009).

Figure 10:
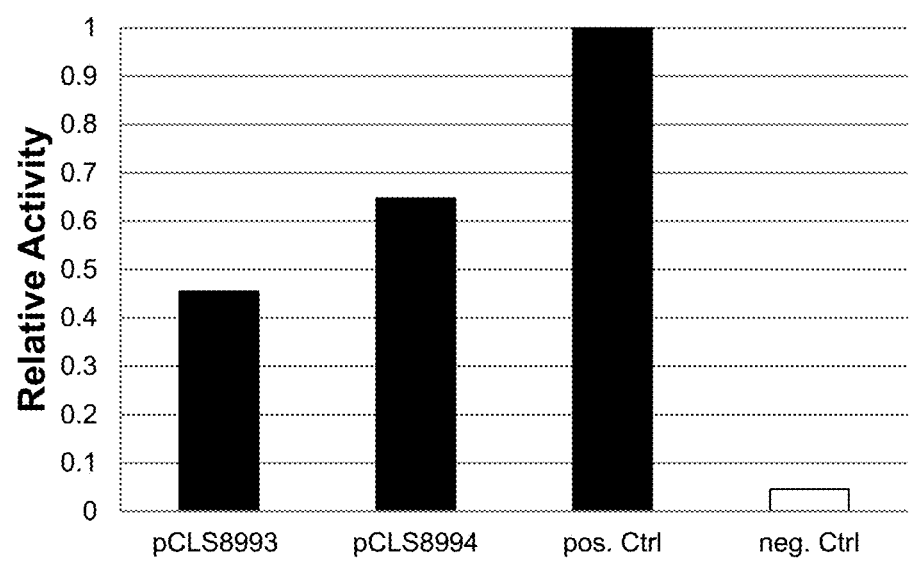
FIG. 10: Activity of TALE-AvrBs3::TevI in mammalian cells. (Extrachromosomic assay in CHO-K1). pCLS8993 (SEQ ID NO: 194) is represented by a black bar and pCLS8994 (SEQ ID NO: 195) is represented by a dark grey bar. Negative control (empty vector) by a white bar and positive control (I-SceI meganuclease) by a light grey bar. Data are normalized relative to the positive control.

Activity levels in mammalian cells for the TALE-AvrBs3::TevI constructs (12.5 ng DNA transfected) on the Avr15 target (SEQ ID NO: 167) are shown in FIG. 10. TALE-AvrBs3::TevI appears to be efficient to cleave the target sequence.

TALE::TevI Nickase Activity

The results described in examples above illustrate two TALE::TevI fusions, each containing one TALE-based DNA binding domain and one I-TevI-based catalytic domain, working to generate detectable activity. The assays used measure tandem repeat recombination by single-strand annealing, a process that is triggered essentially by a DSB (Sugawara and Haber 1992; Paques and Duchateau 2007). TALE::TevI fusions can have a nickase activity insufficient to alone trigger a signal in the cell-based assay. However, two TALE::TevI proteins binding on two nearby sites can sometimes generate two independent nicks, that when proximal and on different DNA strands can create a DSB. In this case, each TALE::TevI is a cTALEN able to generate a nick.

Different experiments are set up to measure TALE::TevI nickase activity:

Super-Coiled Circular Plasmid Nicking and/or Linearization Assay

The sequences encoding the TALE-AvrBs3::TevI constructs cT11Avr_TevD01 and cT11Avr_TevD02 are cloned into a T7-based expression vector using NcoI/EagI restriction sites to yield plasmids pCLS9021 (SEQ ID NO: 201) and pCLS9022 (SEQ ID NO: 202), respectively. This cloning step results in TALE-AvrBs3::TevI proteins having an additional hexa-His tag for purification. Plasmids pCLS9021 and pCLS9022 are then used to produce active proteins by one of two methods:
1. Plasmids are used in a standard in vitro transcription/translation system; lysates from the translation are used directly without further purification.
2. Plasmids are used to transform *E. coli* BL21(DE3) cells for expression using standard protocols, namely: growth to log phase, induction with IPTG, harvest, cell lysis and purification via affinity methods for His-tagged proteins.

Active proteins are assayed against DNA targets having either none, one or two AvrBs3 recognition site sequences. When more than one site is present, identical recognition sequences are juxtaposed with the 3' ends proximal and separated by "spacer" DNA ranging from 5 to 40 bps.

A super-coiled circular plasmid nicking and/or linearization assay is performed. Plasmids harboring the DNA targets described above are prepared by standard methods and column purified to yield super-coiled plasmid of >98% purity. Increasing amounts of TALE-AvrBs3::TevI proteins (prepared as described above) are incubated with each plasmid under conditions to promote DNA cleavage for 1 h at 37° C. Reaction products are separated on agarose gels and visualized by EtBr staining.

Linear DNA Nicking and/or Cleavage Assay

A linear DNA nicking and/or cleavage assay is also performed. PCR products containing the target sequences described above are prepared by standard methods and column purified to yield linear substrate of >98% purity. Increasing amounts of TALE-AvrBs3::TevI proteins (prepared as described above) are then incubated with each PCR substrate under conditions to promote DNA cleavage for 1 h at 37° C. Reaction products are separated on a denaturing acrylamide gel and the single-strand DNA visualized.

Engineering of the TALE::TevI

Variants differing by truncations of the C-terminal domain of the AvrBs3-derived TALEN (SEQ ID NO: 196) are chosen as starting scaffolds. A subset of these variants includes truncation after positions E886 (C0), P897 (C11), G914 (C28), L926 (C40), D950 (C64), R1000 (C115), D1059 (C172) (the protein domains of truncated C-terminal domains C11 to C172 are respectively given in SEQ ID NO: 204 to 209) and P1117 [also referred as Cter wt or WT Cter (SEQ ID NO: 210) lacking the activation domain of the C-terminal domain of natural AvrBs3 (SEQ ID NO: 220)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 211 to 217) which are based on the pCLS7184 (SEQ ID NO: 196)] allow cloning of any catalytic domain in fusion to the C-terminal domain, using the restriction sites BamHI and EagI.

Variants of the catalytic domain of I-TevI (SEQ ID NO: 20) are designed from the N-terminal region of I-TevI. A subset of these variants includes truncations of the catalytic domain, as the deletion-intolerant region of its linker, the deletion-tolerant region of its linker and its zinc finger (SEQ ID NO: 197 to 200) named in Liu et al, 2008 (Liu, Dansereau et al. 2008).

The DNA corresponding to these variants of I-TevI is amplified by the PCR to introduce, at the DNA level, a BamHI (at the 5' of the coding strand) and a EagI (at the 3' of the coding strand) restriction site and, at the protein level, a linker (for example -SGGSGS- stretch, SEQ ID NO: 219) between the C terminal domain of the TALE and the variant of the catalytic domain of I-TevI. The final TALE::TevI constructs are generated by insertion of the variant of I-TevI catalytic domains into the scaffold variants using BamHI and EagI and standard molecular biology procedures.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::TevI constructs were tested in a yeast SSA assay as previously described (International PCT Applications WO 2004/067736 and in Epinat, Arnould et al. 2003; Chames, Epinat et al. 2005; Arnould, Charries et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6).

Example 3b: TevI::TALE Compact TALEN

The sT2 (SEQ ID NO: 135) core TALE scaffold described in example 3a was selected to generate pCLS7865-cTAL11_NFS1 (pCLS9C08, SEQ ID NO: 234), where NFS1 designates the amino acid sequence -GSSG- (SEQ ID NO:468) (with underlying restriction sites BamHI and Kpn2I in the coding DNA to facilitate cloning). Four variants of the I-TevI (SEQ ID NO: 20) catalytic domain were amplified by the PCR on templates TevCreD01 [SEQ ID NO: 109 protein in plasmid pCLS6614 (SEQ ID NO: 146)] using the primer pairs CMP_G001 (SEQ ID NO: 239) and CMP_G067 (SEQ ID NO: 263) or CMP_G152 (SEQ ID NO: 264), TevCreD02 [SEQ ID NO: 110 protein in plasmid pCLS6615 (SEQ ID NO: 203)] using the primer pair CMP_G001 (SEQ ID NO: 239) and CMP_G068 (SEQ ID NO: 240) or TevCreD05 [SEQ ID NO: 113 protein in plasmid pCLS6618 (SEQ ID NO: 258)] using the primer pair CMP_G001 (SEQ ID NO: 239) and CMP_G114 (SEQ ID NO: 265) and subcloned into the pCLS9008 backbone by restriction and ligation using NcoI and Kpn2I restriction sites, yielding pCLS7855-TevW01_cT11 (pCLS15777, SEQ ID NO: 266, encoding the protein of SEQ ID NO: 426), pCLS7865-TevD01_cT11 (pCLS15778, SEQ ID NO: 267, encoding the protein of SEQ ID NO: 427), pCLS7865-TevD02_cT11 (pCLS12730, SEQ ID NO: 235, encoding the protein of SEQ ID NO: 428) and pCLS7865-TevD05_cT11 (pCLS15779, SEQ ID NO: 268, encoding the protein of SEQ ID NO: 429), respectively. Whereas the TevW01_cT11-based fusion contains the dipeptide -SG- linking the TALE-derived DNA binding domain and I-TevI-derived catalytic domain, all others constructs incorporate a longer pentapeptide -QGPSG- (SEQ ID NO:469) to link the domains.

Activity of TevI::TALE in Yeast

The DNA sequence coding for the RVDs to target the AvrBs3 site (SEQ ID NO: 152) was subcloned into plasmids pCLS15777 (SEQ ID NO: 266), pCLS15778 (SEQ ID NO: 267) and pCLS12730 (SEQ ID NO: 235) using Type 115 restriction enzymes BsmBI for the receiving plasmid and BbvI and SfaNI for the inserted RVD sequence to create the subsequent TevI::TALE-AvrBs3 constructs TevW01_cT11Avr (pCLS15780, SEQ ID NO: 269, encoding the protein of SEQ ID NO: 430), TevD01_cT11Avr (pCLS15781, SEQ ID NO: 270, encoding the protein of SEQ ID NO: 431) and TevD02_cT11Avr (pCLS12731, SEQ ID NO: 236, encoding the protein of SEQ ID NO: 432), respectively. A similar cloning technique was used to introduce the RVDs to target the RagT2-R site (SEQ ID NO: 271) into plasmid pCLS15779 (SEQ ID NO: 268) to create the subsequent construct TevD05_cT11RagT2-R (pCLS15782, SEQ ID NO: 272). All TevI::TALE constructs were sequenced and the inserts transferred to additional vectors as needed (see below).

The final TevI::TALE-based yeast expression plasmids, pCLS11979 (SEQ ID NO: 273), pCLS8521 (SEQ ID NO: 274), pCLS8522 (SEQ ID NO: 237) and pCLS12100 (SEQ ID NO: 275), were prepared by yeast in vivo cloning using plasmid pCLS15780 (SEQ ID NO: 269), pCLS15781 (SEQ ID NO: 270), pCLS12731 (SEQ ID NO: 236) and pCLS15782 (SEQ ID NO: 272), respectively. To generate an intact coding sequence by in vivo homologous recombination, approximately 40 ng of each plasmid linearized by digestion with BssHII and 1 ng of the pCLS0542 (SEQ ID NO: 156) plasmid DNA linearized by digestion with NcoI and EagI were used to transform, respectively, the yeast *S. cerevisiae* strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TevI::TALE-AvrBs3 and TevI::TALE-RagT2-R constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6). In addition, constructs were tested on a target having only a single AvrBs3 or RagT2-R recognition site (SEQ ID NO: 238, Table 8). The TevI::TALE-AvrBs3 activity level in yeast was comparable to that of TALE-AvrBs3::TevI (pCLS8524, SEQ ID NO: 155) on suitable targets. Significant activity is illustrated in table 8 for a sample single-site target, according to the cTALEN of the present invention.

TABLE 8

Activity of TevI::TALE-AvrBs3 and and TevI::TALE-RagT2-R on dual- and single-site DNA targets.

| | TALEN Construct | | |
|---|---|---|---|
| Target DNA | TevI::TALE-AvrBs3 | TevI::TALE-RagT2-R | TALE-AvrBs3::FokI |
| Avr25 (dual-site) (SEQ ID NO: 177) | ++++ | n.d. | ++++ |
| Avr25RAGT2R (single-site) (SEQ ID NO: 238) | ++ | ++ | n.d. |

Relative activity is scaled as:
n.d., no activity detectable;
+, <25% activity;
++, 25% to <50% activity;
+++, 50% to <75% activity;
++++, 75% to 100% activity.

Activity of TevI::TALE in Plants

The DNA sequence coding for the RVDs to target the NptIIT5-L and NptIIT6-L sites (SEQ ID NO: 276 to 279) were subcloned into plasmid pCLS12730 (SEQ ID NO: 235) using Type IIS restriction enzymes BsmBI for the receiving plasmid and BbvI and SfaNI for the inserted RVD sequences to create the subsequent TevI::TALE constructs TevD02_cT11NptIIT5-L (pCLS15783, SEQ ID NO: 280) and TevD02_cT11NptIIT6-L (pCLS15784, SEQ ID NO: 281), respectively. The constructs were sequenced and the TevI::TALE inserts transferred by standard cloning techniques to plasmid pCLS14529 (SEQ ID NO: 282) to generate the final TevI::TALE-NptIIT5-L and TevI::TALE-NptIIT6-L expression plasmids, pCLS14579 (SEQ ID NO: 283) and pCLS14581 (SEQ ID NO: 284), respectively. Plasmid pCLS14529 allows for cloning gene of interest sequences downstream of a promoter that confers high levels of constitutive expression in plant cells.

To test activity in plant cells, a YFP-based single-strand annealing (SSA) assay was employed. The YFP reporter gene has a short duplication of coding sequence that is interrupted by either an NptIIT5 or NptIIT6 TALEN target site. Cleavage at the target site stimulates recombination between the repeats, resulting in reconstitution of a functional YFP gene. To quantify cleavage, the reporter is introduced along with a construct encoding a FokI-based TALEN or compact TALEN into tobacco protoplasts by PEG-mediated transformation (as known or derived from the state of the art). Uniform transformation efficiencies were obtained by using the same amount of plasmid in each transformation—i.e. 15 µg each of plasmids encoding YFP and either the TALEN or cTALEN. After 24 hours, the protoplasts were subjected to flow cytometry to quantify the number of YFP positive cells. The TevI::TALE activity levels, using cTALENs according to the present invention, in plants were comparable to those of a FokI-based TALEN control constructs on the targets tested (Table 9).

TABLE 9

Activity of TevI::TALE-NptIIT5-L and TevI::TALE-NptIIT6-L on appropriate DNA targets.

| Target DNA | TALEN Construct | | | |
|---|---|---|---|---|
| | TevI::TALE-NptIIT5-L | NptII5.1 control | TevI::TALE-NptIIT6-L | NptII6.1 control |
| NptII5.1 | +++ | + | n.a. | n.a. |
| NptII6.1 | n.a. | n.a. | + | + |

Relative activity is scaled to the control constructs as:
n.a., not applicable;
+, 100% activity of control (2% YFP positive cells).

Example 3c: TALE::NucA Compact TALEN

NucA (SEQ ID NO: 26), a nonspecific endonuclease from *Anabaena* sp., was fused to a TALE-derived scaffold (composed of a N-terminal domain, a central core composed of RVDs and a C-terminal domain) to create a new class of cTALEN (TALE::NucA). To distinguish the orientation (N-terminal vs. C-terminal) of the catalytic domain (CD) fusions, construct names are written as either CD::TALE-RVD (catalytic-domain is fused N-terminal to the TALE domain) or TALE-RVD::CD (catalytic domain is fused C-terminal to the TALE domain), where "—RVD" optionally designates the sequence recognized by the TALE domain and "CD" is the catalytic domain type. Herein, we describe novel TALE::NucA constructions that target for example the AvrBs3 sequence, and are thus named TALE-AvrBs3::NucA. Notably, the wild-type NucA endonuclease can be inhibited by complex formation with the NuiA protein (SEQ ID NO: 229). In a compact TALEN context, the NuiA protein can function as an auxiliary domain to modulate the nuclease activity of TALE::NucA constructs.

Activity of TALE::NucA in Yeast

A core TALE scaffold, sT2 (SEQ ID NO: 135), was selected onto which (a) different sets of RVD domains could be inserted to change DNA binding specificity, and; (b) a selection of NucA-derived catalytic domains could be attached, N- or C-terminal, to effect DNA cleavage (or nicking). As previously mentioned, the sT2 truncated scaffold was generated by the PCR from a full-length core TALEN scaffold template (pCLS7183, SEQ ID NO: 141) using primers CMP_G061 (SEQ ID NO: 142) and CMP_G065 (SEQ ID NO: 143) and was cloned into vector pCLS7865 (SEQ ID NO: 144) to generate pCLS7865-cTAL11_CFS1 (pCLS9009, SEQ ID NO: 145), where CFS1 designates the amino acid sequence -GSSG- (SEQ ID NO:468) (with underlying restriction sites BamHI and Kpn2 in the coding DNA to facilitate cloning). The NucA (SEQ ID NO: 26) catalytic domain, corresponding to amino acid residues 25 to 274, was subcloned into the pCLS9009 backbone (SEQ ID NO: 145) by restriction and ligation using BamHI and EagI restriction sites, yielding pCLS7865-cT11_NucA (pCLS9937, SEQ ID NO: 221, encoding the protein of SEQ ID NO: 433). The fusion contains the dipeptide -GS- linking the TALE-derived DNA binding domain and NucA-derived catalytic domain. The cloning step also brings at the amino acid level an AAD sequence at the Cter of the NucA catalytic domain.

The DNA sequence coding for the RVDs to target the AvrBs3 site (SEQ ID NO: 152) was subcloned into plasmid pCLS9937 (SEQ ID NO: 221) using Type IIS restriction enzymes BsmBI for the receiving plasmid and BbvI and SfaNI for the inserted RVD sequence to create the subsequent TALE-AvrBs3::NucA construct cT11Avr_NucA (pCLS9938, SEQ ID NO: 222, encoding the protein of SEQ ID NO: 434). The TALE-AvrBs3::NucA construct was sequenced and the insert transferred to additional vectors as needed (see below).

The final TALE-AvrBs3::NucA yeast expression plasmid, pCLS9924 (SEQ ID NO: 223), was prepared by yeast in vivo cloning using plasmid pCLS9938 (SEQ ID NO: 222). To generate an intact coding sequence by in vivo homologous recombination, approximately 40 ng of plasmid (pCLS9938) linearized by digestion with BssHII and 1 ng of the pCLS0542 (SEQ ID NO: 156) plasmid DNA linearized by digestion with NcoI and EagI were used to transform the yeast *S. cerevisiae* strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::NucA construct was tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 7). In addition, constructs were tested on a target having only a single AvrBs3 recognition site (SEQ ID NO: 224; Table 7).

Engineering of the TALE::NucA

Variants differing by truncations of the C-terminal domain of the AvrBs3-derived TALEN (SEQ ID NO: 196) are chosen as starting scaffolds. A subset of these variants includes truncation after positions E886 (C0), P897 (C11), G914 (C28), L926 (C40), D950 (C64), R1000 (C115), D1059 (C172) (the protein domains of truncated C-terminal domains C11 to C172 are respectively given in SEQ ID NO: 204 to 209) and P1117 [also referred as Cter wt or WT Cter (SEQ ID NO: 210) lacking the activation domain of the C-terminal domain of natural AvrBs3 (SEQ ID NO: 220)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 211 to 217) which are based on the pCLS7184 (SEQ ID NO: 196)] allow cloning of any catalytic domain in fusion to the C-terminal domain, using the restriction sites BamHI and EagI.

The DNA corresponding to amino acid residues 25 to 274 of NucA is amplified by the PCR to introduce, at the DNA level, a BamHI (at the 5' of the coding strand) and a EagI (at the 3' of the coding strand) restriction site and, at the protein level, a linker (for example -SGGSGS- stretch, SEQ ID NO: 219) between the C terminal domain of the TALE and the NucA catalytic domain. The final TALE::NucA constructs are generated by insertion of the NucA catalytic domain into the scaffold variants using BamHI and EagI and standard molecular biology procedures. For example, scaffold variants truncated after positions P897 (C11), G914 (C28) and D950 (C64), respectively encoded by pCLS7803, pCLS7807, pCLS7811, (SEQ ID NO: 212, 213 and 215), were fused to the NucA catalytic domain (SEQ ID NO: 26), leading to pCLS9596, pCLS9597, and pCLS9599 (SEQ ID NO: 225 to 227). The cloning step also brings at the amino acid level an AAD sequence at the Cter of the NucA catalytic domain.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::NucA constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 7). In addition, TALE-AvrBs3::NucA constructs were tested on a target having only a single AvrBs3 recognition site (SEQ ID NO: 224). Data summarized in FIG. 11 show that TALE-AvrBs3::NucA constructs are active on all targets having at least one AvrBs3 recognition site, according to the cTALEN of the present invention.

Example 3d: TALE::ColE7 Compact TALEN

The catalytic domain of ColE7 (SEQ ID NO: 140), a nonspecific endonuclease from *E. coli*, was fused to a TALE-derived scaffold (composed of a N-terminal domain, a central core composed of RVDs and a C-terminal domain) to create a new class of cTALEN (TALE::ColE7). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "—RVD" optionally designates the sequence recognized by the TALE domain and "CD" is the catalytic domain type. Herein, we describe novel TALE::ColE7 constructions that target for example the AvrBs3 sequence, and are thus named TALE-AvrBs3::ColE7. Notably, the wild-type ColE7 endonuclease can be inhibited by complex formation with the Im7 immunity protein (SEQ ID NO: 230). In a compact TALEN context, the Im7 protein can function as an auxiliary domain to modulate the nuclease activity of TALE::ColE7 constructs.

Activity of TALE::ColE7 in Yeast

A core TALE scaffold, sT2 (SEQ ID NO: 135), was selected onto which (a) different sets of RVD domains could be inserted to change DNA binding specificity, and; (b) a selection of ColE7-derived catalytic domains could be attached, N- or C-terminal, to effect DNA cleavage (or nicking). As previously mentioned, the sT2 truncated scaffold was generated by the PCR from a full-length core TALEN scaffold template (pCLS7183, SEQ ID NO: 141) using primers CMP_G061 (SEQ ID NO: 142) and CMP_G065 (SEQ ID NO: 143) and was cloned into vector pCLS7865 (SEQ ID NO: 144) to generate pCLS7865-cTAL11_CFS1 (pCLS9009, SEQ ID NO: 145), where CFS1 designates the amino acid sequence -GSSG- (SEQ ID NO:468) (with underlying restriction sites BamHI and Kpn2I in the coding DNA to facilitate cloning). The ColE7 (SEQ ID NO: 140) catalytic domain was subcloned into the pCLS9009 backbone by restriction and ligation using Kpn2I and EagI restriction sites, yielding pCLS7855-cT11_ColE7 (pCLS9939, SEQ ID NO: 231, encoding the protein of SEQ ID NO: 435). The fusion contains the dipeptide -GSSG- (SEQ ID NO:468) linking the TALE-derived DNA binding domain and ColE7-derived catalytic domain.

The DNA sequence coding for the RVDs to target the AvrBs3 site (SEQ ID NO: 152) was subcloned into plasmid pCLS9939 (SEQ ID NO: 231) using Type IIS restriction enzymes BsmBI for the receiving plasmid and BbvI and SfaNI for the inserted RVD sequence to create the subsequent TALE-AvrBs3::ColE7 construct cT11Avr_ColE7 (pCLS9940, SEQ ID NO: 232, encoding the protein of SEQ ID NO: 436). The TALE-AvrBs3::ColE7 construct was sequenced and the insert transferred to additional vectors as needed (see below).

The final TALE-AvrBs3::ColE7 yeast expression plasmid, pCLS8S89 (SEQ ID NO: 233), was prepared by yeast in vivo cloning using plasmid pCLS9940 (SEQ ID NO: 232). To generate an intact coding sequence by in vivo homologous recombination, approximately 40 ng of plasmid (pCLS9940) linearized by digestion with BssHII and 1 ng of the pCLS0542 (SEQ ID NO: 156) plasmid DNA linearized by digestion with NcoI and EagI were used to transform the yeast *S. cerevisiae* strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::ColE7 construct was tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 7). In addition, constructs were tested on a target having only a single AvrBs3 recognition site (SEQ ID NO: 224, Table 7). TALE-AvrBs3::ColE7 activity levels on the respective targets in yeast cells are shown in FIG. 12.

Activity of TALE::ColE7 in Plants

The DNA sequence coding for the RVDs to target the NptIIT5-L and NptIIT6-L sites (SEQ ID NO: 276 to 279) were subcloned into plasmid pCLS15785 (SEQ ID NO: 285, a C-terminally modified ColE7 K497A mutant of plasmid pCLS9939, SEQ ID NO: 231) using Type 115 restriction enzymes BsmBI for the receiving plasmid and BbvI and SfaNI for the inserted RVD sequences to create the subsequent TALE::ColE7_A497 constructs cT11NptIIT5-

L_ColE7_A497 (pCLS15786, SEQ ID NO: 286) and cT11NptIIT6-L_ColE7_A497 (pCLS15787, SEQ ID NO: 287), respectively. The constructs were sequenced and the TALE::ColE7_A497 inserts transferred by standard cloning techniques to plasmid pCLS14529 (SEQ ID NO: 282) to generate the final TALE-NptIIT5-L::ColE7_A497 and TALE-NptIIT6-L::ColE7_A497 expression plasmids, pCLS14584 (SEQ ID NO: 288, encoding the protein of SEQ ID NO: 437) and pCLS14587 (SEQ ID NO: 289, encoding the protein of SEQ ID NO: 438), respectively. Plasmid pCLS14529 allows for cloning gene of interest sequences downstream of a promoter that confers high levels of constitutive expression in plant cells.

To test activity in plant cells, a YFP-based single-strand annealing (SSA) assay was employed. The YFP reporter gene has a short duplication of coding sequence that is interrupted by either an NptIIT5 or NptIIT6 TALEN target site. Cleavage at the target site stimulates recombination between the repeats, resulting in reconstitution of a functional YFP gene. To quantify cleavage, the reporter is introduced along with a construct encoding a FokI-based TALEN or compact TALEN into tobacco protoplasts by PEG-mediated transformation. Uniform transformation efficiencies were obtained by using the same amount of plasmid in each transformation—i.e. 15 μg each of plasmids encoding YFP and either the TALEN or cTALEN. After 24 hours, the protoplasts were subjected to flow cytometry to quantify the number of YFP positive cells. The TALE::ColE7_A497 activity levels, using cTALENs according to the present invention, in plants were comparable to those of a FokI-based TALEN control constructs on the targets tested (Table 10).

TABLE 10

Activity of TALE-NptIIT5-L::ColE7_A497 and TALE-NptIIT6-L::ColE7_A497 on appropriate DNA targets.

| | TALEN Construct | | | |
| --- | --- | --- | --- | --- |
| Target DNA | TALE-NptIIT5-L::ColE7_A497 | NptII5.1 control | TALE-NptII6-L::ColE7_A497 | NptII6.1 control |
| NptII5.1 | + | + | n.a. | n.a. |
| NptII6.1 | n.a. | n.a. | + | + |

Relative activity is scaled to the control constructs as:
n.a., not applicable;
+, 100% activity of control (8% YFP positive cells).

Engineering of the TALE::ColE7

Variants differing by truncations of the C-terminal domain of the AvrBs3-derived TALEN (SEQ ID NO: 196) are chosen as starting scaffolds. A subset of these variants includes truncation after positions E886 (C0), P897 (C11), G914 (C28), L926 (C40), D950 (C64), R1000 (C115), D1059 (C172) (the protein domains of truncated C-terminal domains C11 to C172 are respectively given in SEQ ID NO: 204 to 209) and P1117 [also referred as Cter wt or WT Cter (SEQ ID NO: 210) lacking the activation domain of the C-terminal domain of natural Av-Bs3 (SEQ ID NO: 220)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 211 to 217) which are based on the pCLS7184 (SEQ ID NO: 196)] allow cloning of any catalytic domain in fusion to the C-terminal domain, using the restriction sites BamHI and EagI.

The DNA corresponding to the catalytic domain of ColE7 is amplified by the PCR to introduce, at the DNA level, a BamHI (at the 5' of the coding strand) and a EagI (at the 3' of the coding strand) restriction site and, at the protein level, a linker (for example -SGGSGS- stretch, SEQ ID NO: 219) between the C terminal domain of the TALE and the ColE7 catalytic domain. Additionally, variants of the ColE7 endonuclease domain that modulate catalytic activity can be generated having changes (individually or combined) at the following positions: K446, R447, D493, R496, K497, H545, N560 and H573 [positions refer to the amino acid sequence of the entire ColE7 protein (SEQ ID NO: 11)]. The final TALE::ColE7 constructs are generated by insertion of the ColE7 catalytic domain into the scaffold variants using BamHI and EagI and standard molecular biology procedures.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::ColE7 constructs are tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 7). In addition, constructs were tested on a target having only a single AvrBs3 recognition site (SEQ ID NO: 224, Table 7).

Example 3e: TALE::CreI Compact TALEN

The wild-type I-CreI meganuclease (SEQ ID NO: 106) was chosen as a protein template to derive a sequence-specific catalytic domain that when fused to a TALE-derived scaffold (composed of a N-terminal domain, a central core composed of RVDs and a C-terminal domain) would generate a new class of cTALEN (TALE::CreI). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "—RVD" optionally designates the sequence recognized by the TALE domain and "CD" is the catalytic domain type. Herein, we describe novel TALE::CreI-based constructions that target for example the T cell receptor B gene (TCRB gene, SEQ ID NO: 290, FIG. 13) sequence, both via the TALE DNA binding domain and the re-engineered I-CreI domain. Notably, specificity of the TALE::CreI compact TALEN is driven by both the TALE DNA binding domain as well as the I-CreI-derived catalytic domain. In a compact TALEN context, such proteins can provide, within a reasonably-sized monomeric protein, the requisite high specificity demanded by therapeutic applications.

Activity of TALE::CreI in Yeast

A core TALE scaffold, sT2 (SEQ ID NO: 135), was selected onto which (a) different sets of RVD domains could be inserted to change DNA binding specificity, and; (b) a selection of I-CreI-derived catalytic domains could be attached, N- or C-terminal, to effect DNA cleavage (or nicking). As previously mentioned, the sT2 truncated scaffold was generated by the PCR from a full-length core TALEN scaffold template (pCLS7183, SEQ ID NO: 141) using primers CMP_G061 (SEQ ID NO: 142) and CMP_G065 (SEQ ID NO: 143) and was cloned into vector pCLS7865 (SEQ ID NO: 144) to generate pCLS7865-cTAL11_CFS1 (pCLS9009, SEQ ID NO: 145), where CFS1 designates the amino acid sequence -GSSG- (SEQ ID NO:468) (with underlying restriction sites BamHI and Kpn21 in the coding DNA to facilitate cloning). A re-engineered I-CreI catalytic domain, designed to target a sequence in the T cell receptor B gene (TCRB gene, SEQ ID NO: 290, FIG. 13), was subcloned in two steps. First, the I-CreI_NFS1 (SEQ ID NO: 122) scaffold, where NFS1 (SEQ ID NO: 98) comprises a linker of 20 amino acids -GSDITKSKISEKMKGQGPSG- (SEQ ID NO:98) (with underlying restriction sites BamHI and Kpn21 in the coding DNA to facilitate cloning), was fused to the pCLS7865-cTAL11_CFS1 scaffold (using BamHI and EagI restriction sites) to insert the NFS1 linker in-frame to the coding sequence. The I-CreI meganuclease was subsequently replaced by the engineered TCRB02-A meganuclease (pCLSE857, SEQ ID NO: 291) construct using Kpn21 and XhoI restriction sites, yielding pCLS7865-cT11_scTB2aD01 (pCLS15788, SEQ ID NO: 292, encoding the protein of SEQ ID NO: 439). Two point-mutant variants of the TCRB02-A meganuclease, TCRB02-A_148C (pCLS12083, SEQ ID NO: 293, encoding the protein of SEQ ID NO: 442) and TCRB02-A_333C (pCLS12195, SEQ ID NO: 294, encoding the protein of SEQ ID NO: 443), were also subcloned as catalytic domains fused to a TALE binding core, yielding constructs pCLS7865-cT11_scTB2aD01_148C (pCLS15789, SEQ ID NO: 295, encoding the protein of SEQ ID NO: 440) and pCLS7865-cT11_scTB2aD01_333C (pCLS15790, SEQ ID NO: 296, encoding the protein of SEQ ID NO. 441).

Three DNA sequences coding for RVDs that target the TCRB gene were designed at different distances from the meganuclease site, leading to RVDs TCRB02A1 (SEQ ID NO: 297), TCRB02A2 (SEQ ID NO: 298) and TCRB02A3 (SEQ ID NO: 299) that target sequences located 7 bp, 12 bp and, 16 bp, respectively, upstream of the meganuclease TCRB site (FIG. 13). DNA sequences for each RVD were independently subcloned into plasmid pCLS15788 (SEQ ID NO: 292) using Type IIS restriction enzymes BsmBI for the receiving plasmid and BbvI and SfaNI for the inserted RVD sequence to create the subsequent TALE::scTB2aD01 constructs cT11TB2A1_scTB2aD01 (pCLS15791, SEQ ID NO: 300), cT11TB2A2_scTB2aD01 (pCLS15792, SEQ ID NO: 301) and cT11TB2A3_scTB2aD01 (pCLS15793, SEQ ID NO: 302). Additionally, the TCRB02A2 (SEQ ID NO: 298) RVDs were similarly cloned into pCLS15789 (SEQ ID NO: 295) to create cT11TB2A2_scTB2aD01_148C (pCLS15794, SEQ ID NO: 303). All constructs were sequenced and the various inserts transferred to additional vectors as needed (see below).

The final TALE:::scTB2aD01 yeast expression plasmids, pCLS13449 (SEQ ID NO: 304, encoding the protein of SEQ ID NO: 444), pCLS13450 (SEQ ID NO: 305, encoding the protein of SEQ ID NO: 445), pCLS13451 (SEQ ID NO: 306, encoding the protein of SEQ ID NO: 446) and pCLS15148 (SEQ ID NO: 307, encoding the protein of SEQ ID NO: 455), were prepared by yeast in vivo cloning using plasmids pCLS15791 (SEQ ID NO: 300), pCLS15792 (SEQ ID NO: 301), pCLS15793 (SEQ ID NO: 302) and pCLS15794 (SEQ ID NO: 303), respectively. To generate an intact coding sequence by in vivo homologous recombination, approximately 40 ng of each plasmid linearized by digestion with BssHII and 1 ng of the pCLS0542 (SEQ ID NO: 156) plasmid DNA linearized by digestion with NcoI and EagI were used to transform, respectively, the yeast *S. cerevisiae* strain FYC2-6A (MATα, trp1Δ63, leu2Δ1, his3Δ200) using a high efficiency LiAc transformation protocol (Arnould et al. 2007).

All the yeast target reporter plasmids containing the TALEN or meganuclease DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE::scTB2aD01-based constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on hybrid targets TCRB02Tsp7 (SEQ ID NO: AC4), TCRB02Tsp12 (SEQ ID NO: AC5) and TCRB02Tsp16 (SEQ ID NO: AC6), illustrated in FIG. 14.

The TCRB02.1-only target was included to compare activity with the engineered TCRB02-A meganuclease (pCLS6857, SEQ ID NO: 291), which does not require the TALE DNA binding sites for activity. Activity levels on the respective targets in yeast cells for the indicated TALE::scTB2aD01-based constructs are shown in FIG. 14. Notably, under the in vivo conditions tested the TALE-TB2A2::scTB2aD01_148C (pCLS15794, SEQ ID NO: 303) construct no longer cleaves targets lacking the DNA sequence recognized by the TALE DNA binding moiety.

Activity of TALE::CreI in Mammalian Cells

DNA encoding the TALE-TB2A2::scTB2aD01 and TALE-TB2A3::scTB2aD01 constructs from pCLS15792 (SEQ ID NO: 301) and pCLS15793 (SEQ ID NO: 302) were subcloned into the pCLS1853 (SEQ ID NO: 193) mammalian expression plasmid using AscI and XhoI, restriction enzymes for the receiving plasmid and BssHII and XhoI restriction enzymes for TALE::scTB2aD01-based inserts, leading to the mammalian expression plasmids pCLS14894 and pCLS14895 (SEQ ID NO: 308 and 309), respectively.

All mammalian target reporter plasmids containing the TALEN DNA target sequences were constructed using the standard Gateway protocol (INVITROGEN) into a CHO reporter vector (Arnould, Chames et al. 2006, Grizot, Epinat et al. 2010).

Figure 15:
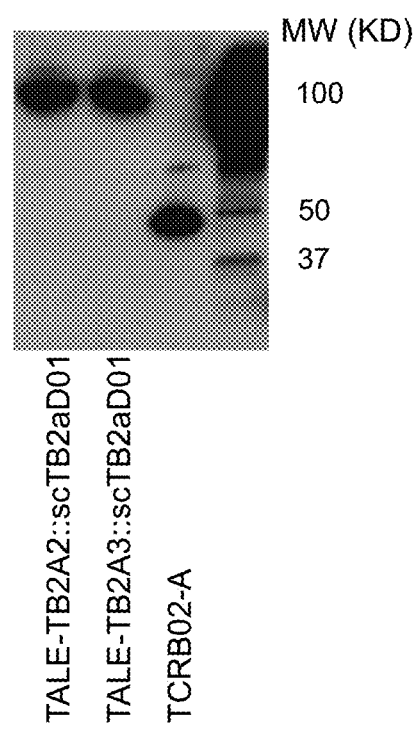
FIG. 15: Western blot of TALE::scTB2aD01-based constructs. Constructs were expressed in HEK293 cells and total protein extracts were prepared 48 hours post-transfection. Protein was detected using a polyclonal anti-I-CreI antibody.

To monitor protein expression levels, TALE::scTB2aD01-based constructs were transfected in mammalian cells (HEK293) alongside the engineered TCRB02-A meganuclease (pCLS6857, SEQ ID NO: 291). Briefly, cells were transfected, respectively, with 300 ng of each protein encoding plasmid in the presence of lipofectamine. Forty-eight hours post-transfection, 20 µg of total protein extract for each sample was analyzed by Western-Blot using a polyclonal anti-I-CreI antibody. A typical western-blot is shown in FIG. 15.

Figure 16:
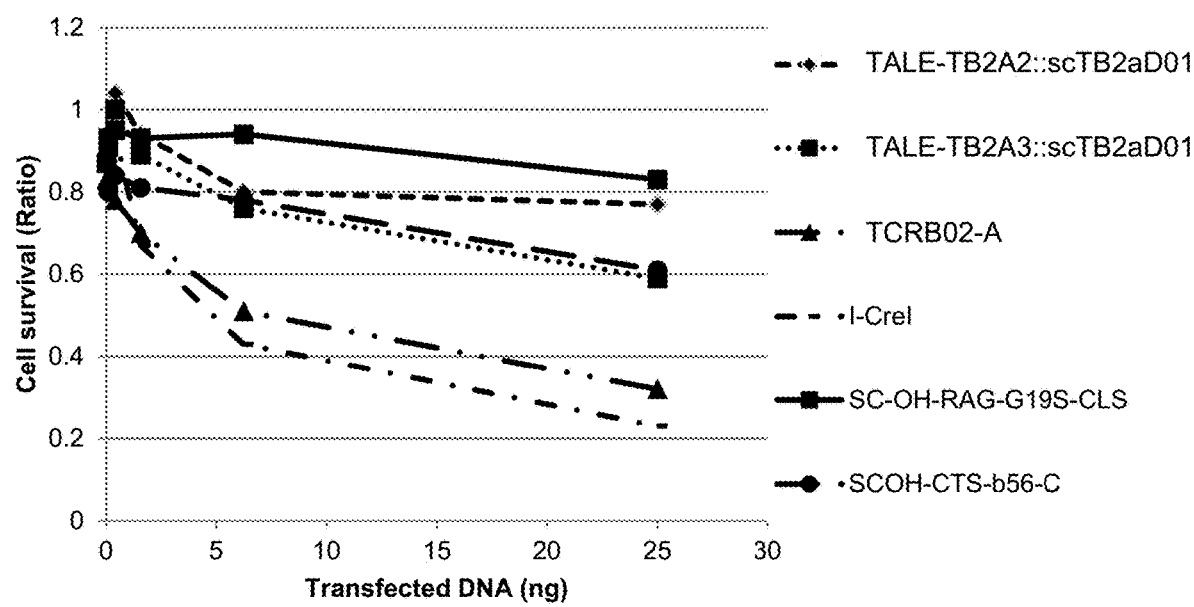
FIG. 16: Toxicity of TALE::scTB2aD01-based constructs in CHOK1 cells. Cytotoxicity is based on detectable levels of GFP expressed in living cells, on day 1 vs day 6, relative to a standard control (transfection of empty plasmid).

Relative toxicity of the TALE::scTB2aD01-based constructs was assessed using a cell survival assay. CHOK1 cells were used to seed plates at a density of $2.5*10^3$ cells per well. The following day, varying amounts of plasmid encoding either the TALE::scTB2aD01-based constructs (pCLS14894 and pCLS14895; SEQ ID NO: 308 and 309) or the engineered TCRB02-A meganuclease (pCLS6857, SEQ ID NO: 291) and a constant amount of GFP-encoding plasmid (10 ng) were used to transfect the cells with a total quantity of 200 ng using Polyfect reagent. GFP levels were monitored by flow cytometry (Guava Easycyte, Guava technologies) on days 1 and 6 post-transfection. Cell survival is expressed as a percentage, calculated as a ratio (TALEN and meganuclease-transfected cells expressing GFP on Day 6/control-transfected cells expressing GFP on Day 6) corrected for the transfection efficiency determined on Day 1. Typical cell survival assay data are shown in FIG. 16.

Figure 17:
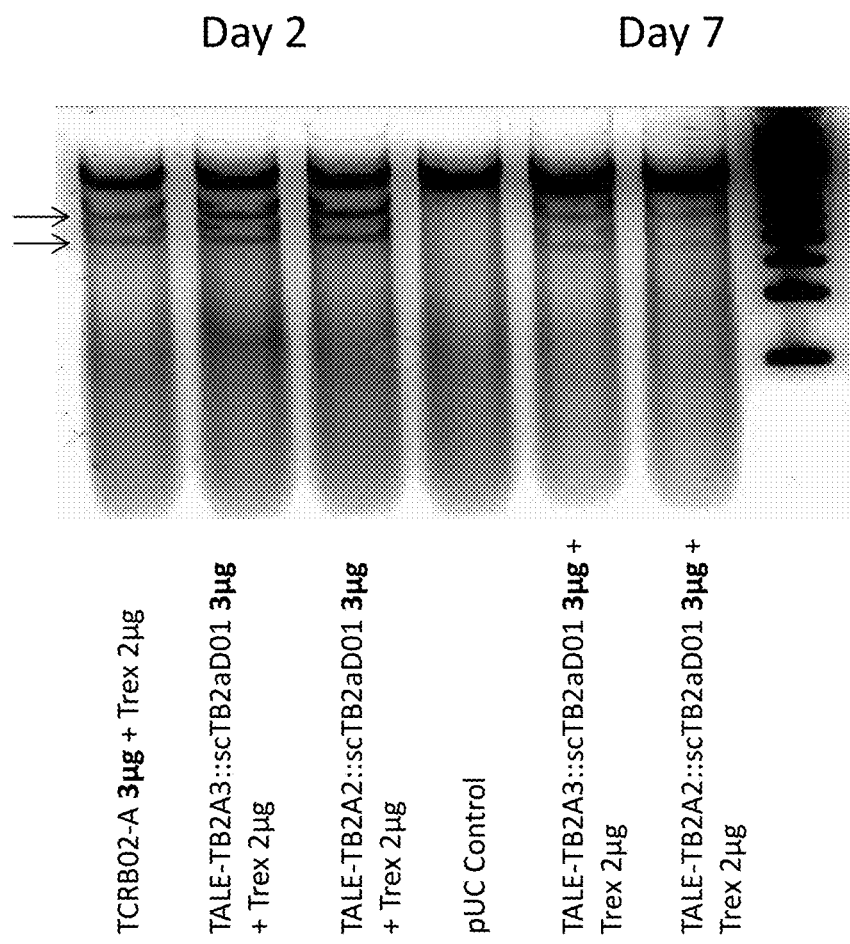
FIG. 17: NHEJ activity of TALE::scTB2aD01-based constructs in HEK293 cells. A post-transfection PCR-based analysis of genomic DNA is used to assess activity in vivo. Cleavage of mismatched DNA sequences by T7 endonuclease is indicative of NHEJ events resulting from the activity of the cTALEN or meganuclease at the targeted locus.

Cleavage activity in vivo was monitored via detection of NHEJ events in the presence of TREX2 exonuclease. Plasmid (3 µg) encoding either the TALE::scTB2aD01-based constructs (pCLS14894 and pCLS14895; SEQ ID NO: 308 and 309) or the engineered TCRB02-A meganuclease (pCLS6857, SEQ ID NO: 291) and 2 µg of scTrer2-encoding plasmid (pCLS8982, SEQ ID NO: 310) were used to transfect the HEK293 cells in the presence of lipofectamine. Genomic DNA was extracted 2 and 7 days post-transfection with the DNeasy Blood and Tissue kit (Qiagen) and the region encompassing the TCRB02 site (FIG. 13) was amplified using the PCR with oligos TRBC2F3 (Seq ID NO: 311) and TRBC2R3B (SEQ ID NO: 312) at day 2 post-transfection and with oligos TRBC2F4 (SEQ ID NO: 315) and TRBC2R4B (SEQ ID NO: 314) at day 7 post-transfection. Respective PCR products (100 ng) were heat denatured, allowed to re-anneal by slow-cooling then treated with T7 endonuclease 1 (NEB) for 15 minutes at 37° C. Digested PCR products are separated on 10% acrylamide gels and visualized with SYBRgreen (Invitrogen) staining. Cleavage of mismatched DNA sequences by T7 endonuclease is indicative of NHEJ events resulting from the activity of the cTALEN or meganuclease at the targeted locus. FIG. 17 illustrates the detectable NHEJ activity of the TALE::scTB2aD01-based constructs (pCLS14894 and pCLS14895; SEQ ID NO: 308 and 309) compared to the engineered TCRB02-A meganuclease (pCLS6857, SEQ ID NO: 291). Whereas at day 2 NHEJ results are comparable for all constructs, NHEJ activity at day 7 can only be detected for the TALE::scTB2aD01-based constructs, suggesting that these compact TALENs do not induce cytotoxicity.

Engineering cf the TALE::CreI A significant novel property of the TALE::CreI compact TALEN resides in the ability to independently engineer the "hybrid" specificity of the final molecule. As such, the inherent activity/specificity ratio can be modulated within the TALE::CreI-derived constructs, allowing for unprecedented specific targeting with retention of high DNA cleavage activity. In its simplest form, successful re-targeting of the TALE DNA binding domain is achieved via the RVD cipher (FIG. 3), with a pseudo one-to-one correspondence to the underlying DNA base. Engineering of the I-CreI moiety, however, presents more challenges insomuch as there exists a potential codependence of protein-DNA contacts needed for suitable DNA binding and cleavage activity. Methods have been described (WO2006097854, WO2008093249, WO03078619, WO2009095793; WO 2007/049095, WO 2007/057781, WO 2006/097784, WO 2006/097853, WO 2007/060495, WO 2007/049156 and WO 2004/067736) to successfully re-engineer the I-CreI meganuclease to target novel DNA sequences. As some of these methods rely on a clustered approach, it can be envisioned that using said approach the "absolute" specificity of the I-CreI moiety could be reduced in a stepwise manner. For example, the breakdown of the I-CreI DNA interaction surface into discrete 10NNN, 7NN, 5NNN and 2NN regions (per monomeric subunit half) allows for novel engineering wherein high specificity is maintained in the central 5NNN-2NN region at the expense of "loose" or broad specificity in the outer 10NNN-7NN regions. In essence such an approach could reduce the complexity of re-engineering the I-CreI-derived scaffold for a compact TALEN context as only "selectivity" in cleavage is required for the catalytic domain, with subsequent specificity provided by the TALE DNA binding part of the protein fusion. Taken together, the ease of engineering combined with the potential high specificity and high DNA cleavage activity make TALE::CreI-derived compact TALENs ideal tools for therapeutic applications. Finally, it should be noted that the I-CreI moiety could in principle be replaced with a host of naturally existing or re-engineered homing endonuclease-derived catalytic domains.

Example 3f: Activity of TALE::SnaseSTAUU

Activity of TALE::SnaseSTAUU in Yeast Variants differing by truncations of the C-terminal domain of the AvrBs3-derived TALEN (SEQ ID NO: 196) are chosen as starting scaffolds. A subset of these variants includes truncation after positions G914 (C28) and L926 (C40) (the protein domains of truncated C-terminal domains C28 and C40 are respectively given in SEQ ID NO: 205 and 206). The plasmids coding for the variant scaffolds containing the AvrBs3-derived N-terminal domain, the AvrBs3-derived set of repeat domains and the truncated AvrBs3-derived C-terminal domain [pCLS7807 and pCLS7809, (SEQ ID NO: 213 and 214) which are based on the pCLS7184 (SEQ ID NO: 196)] allow cloning of any catalytic domain in fusion to the C-terminal domain, using the restriction sites BamHI and EagI.

The DNA corresponding to amino acid residues 83 to 231 of SnaseSTAAU (SEQ ID NO: 30) is amplified by the PCR to introduce at the DNA level, a BamHI (at the 5' of the coding strand) and a EagI (at the 3' of the coding strand) restriction site and, at the protein level, a linker (for example -SGGSGS- stretch, SEQ ID NO: 219) between the C terminal domain of the TALE and the SnaseSTAAU catalytic domain. The final TALE::SnaseSTAAU constructs are generated by insertion of the SnaseSTAAU catalytic domain into the scaffold variants using BamHI and EagI and standard molecular biology procedures. Scaffold variants truncated after positions G914 (C28) and L926 (C40), respectively encoded by pCLS7807 and pCLS7809, (SEQ ID NO: 213 and 214), were fused to the SnaseSTAAU catalytic domain (SEQ ID NO: 30), leading to pCLS9082 and pCLS9081 (SEQ ID NO: 370 and 371). The cloning step also brings at the amino acid level an AAD sequence at the Cter of the SnaseSTAAU catalytic domain.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::SnaseSTAAU constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer". DNA ranging from 5 to 40 bps (SEQ ID NO: 157 to 192, Table 7). In addition, TALE-AvrBs3::SnaseSTAAU constructs were tested on a target having only a single AvrBs3 recognition site (SEQ ID NO: 224). Data summarized in FIG. 19 show that TALE-AvrBs3::SnaseSTAAU constructs are active on targets having two AvrBs3 recognition site, according to the chimeric protein of the present invention, but also on targets containing only one AvrBs3 recognition site.

Example 4

Basic cTALENs are composed of a single DNA binding domain fused to a single catalytic domain and are designed to stimulate HR via a single double-strand DNA cleavage or single-strand nicking event. For certain applications (e.g. gene inactivation), it is favorable to enhance the level of NHEJ. This example illustrates the creation of a dual-cleavage cTALEN (dcTALEN) that is capable of effecting cleavage of double-strand DNA at two distinct sites flanking the TALE DNA binding domain (FIG. 5C). The simultaneous cleavage of the DNA at the two sites is expected to eliminate the intervening sequence and therefore abolish "scarless" re-ligation by NHEJ (FIG. 1).

The baseline scaffolds (SEQ ID NO: 136 to SEQ ID NO: 139) described in Example 3 are used as starting points for fusion designs. A non-exhaustive list of catalytic domains amenable to fusion with TALE DNA binding domains is presented in Table 2. A non-exhaustive list of linkers that can be used is presented in Table 3. See examples 3, 5, 6 and 7 for additional details concerning the choice of linker or enhancement domain. For the dcTALEN designs, at least one cleavase domain is fused (N- or C-terminal) to the TALE DNA binding domain. The additional catalytic domain can be either a nickase of cleavase (endonuclease or exonuclease) domain, and depends on the nature of the application. For example, the coupling of a cleavase domain on one side with a nickase domain on the other could result in excision of a single-strand of DNA spanning the TALE DNA binding region. The targeted generation of extended single-strand overhangs could be applied in applications that target DNA repair mechanisms. For targeted gene inactivation, the use of two cleavase domains in the dcTALEN is preferred.

All dcTALEN designs are assessed using our yeast assay (see Example 1) and provide detectable activity comparable to existing engineered meganucleases. Furthermore, potential enhancements in NHEJ are monitored using the mammalian cell based assay as described in Example 3.

Example 4a: Activity of TevI::TALE::FokI and TevI::TALE::TevI Dual Cleavage TALENs Dual cleavage TALENs (CD::TALE::CD), possessing an N-terminal I-TevI-derived catalytic domain and a C-terminal catalytic domain derived from either FokI (SEQ ID NO:368) or I-TevI (SEQ ID NO: 20), were generated on the baseline bT2-Avr (SEQ ID NO: 137) scaffold. The catalytic domain fragment of I-TevI was excised from plasmid pCLS12731 (SEQ ID NO: 236) and subcloned into vectors pCLS15795 (SEQ ID NO: 351) and pCLS9013 (SEQ ID NO: 153) by restriction and ligation using NcoI and NsiI restriction sites, yielding TevD02_cT11Avr_FokI-L (pCLS15796, SEQ ID NO: 352, encoding the protein of SEQ ID NO: 447) and TevD02_cT11Avr_TevD02 (pCLS15797, SEQ ID NO: 353, encoding the protein of SEQ ID NO: 448), respectively. All constructs were sequenced and the insert transferred to additional vectors as needed (see below).

The final TevI::TALE-AvrBs3::FokI and TevI::TALE-AvrBs3::TevI yeast expression plasmids, pCLS13299 (SEQ ID NO: 354, encoding the protein of SEQ ID NO: 449) and pCLS13301 (SEQ ID NO: 355, encoding the protein of SEQ ID NO: 450), were prepared by yeast in vivo cloning using plasmids pCLS15796 (SEQ ID NO: 352) and pCLS15797 (SEQ ID NO: 353), respectively. To generate an intact coding sequence by i: vivo homologous recombination, approximately 40 ng of each plasmid linearized by digestion with BssHII and 1 ng of the pCLS0542 (SEQ ID NO: 156) plasmid DNA linearized by digestion with NcoI and EagI were used to transform, respectively, the yeast S. cerevisiae strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TevI::TALE-AvrBs3::FokI and TevI::TALE-AvrBs3::TevI constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN (pCLS8590, SEQ ID NO: 244), which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6). In addition, constructs were tested on a target having only a single AvrBs3 or RagT2-R recognition site (SEQ ID NO: 238, Table 11). On suitable targets, the TevI::TALE-AvrBs3::FokI and TevI::TALE-AvrBs3::TevI activity levels in yeast were comparable to those of their parent molecules lacking the N-terminal I-TevI-derived catalytic domain. Significant activity is illustrated in table 11 for a sample single-site target, according to the dcTALEN of the present invention.

TABLE 11

Activity of various cTALENs and dcTALENs on dual- and single-site DNA targets.

| TALEN Construct | Target DNA | |
|---|---|---|
| | Avr25 (dual-site) (SEQ ID NO: 177) | Avr25RAGT2R (single-site) (SEQ ID NO: 238) |
| TevI::TALE-AvrBs3 | ++++ | +++ |
| TALE-AvrBs3::FokI | ++++ | n.d. |
| TALE-AvrBs3::TevI | ++++ | n.d. |
| TevI::TALE-AvrBs3::FokI | ++++ | +++ |
| TevI::TALE-AvrBs3::TevI | ++++ | +++ |

Relative activity is scaled as:
n.d., no activity detectable;
+, <25% activity;
++, 25% to <50% activity;
+++, 50% to <75% activity;
++++, 75% to 100% activity.

Example 4b: scTrex2::TALE::FokI Dual Cleavage TALEN

A dual cleavage TALEN (CD::TALE::CD), possessing an N-terminal scTrex2-derived catalytic domain and a C-terminal catalytic domain derived from FokI, was generated on the baseline bT2-Avr (SEQ ID NO: 137) scaffold. The catalytic domain fragment of scTrex2 was excised from plasmid pCLS15798 (SEQ ID NO: 356, encoding the protein of SEQ ID NO: 451) and subcloned into vector pCLS15795 (SEQ ID NO: 351) by restriction and ligation using NcoI and NsiI restriction sites, yielding scTrex2_cT11Avr_FokI-L (pCLS15799, SEQ ID NO: 357, encoding the protein of SEQ ID NO: 452). The construct was sequenced and the insert transferred to additional vectors as needed (see below).

DNA encoding the TALE-AvrBs3::FokI or scTrex2::TALE-AvrBs3::FokI constructs from either pCLS15795 (SEQ ID NO: 351) or pCLS15799 (SEQ ID NO: 357), respectively, was subcloned into the pCLS1853 (SEQ ID NO: 193) mammalian expression plasmid using AscI and XhoI restriction enzymes for the receiving plasmid and BssHII and XhoI restriction enzymes for the inserts, leading to the mammalian expression plasmids pCLS14972 and pCLS14971 (SEQ ID NO: 358 and 359), respectively.

All mammalian target reporter plasmids containing the TALEN DNA target sequences were constructed using the standard Gateway protocol (INVITROGEN) into a CHO reporter vector (Arnould, Chames et al. 2006, Grizot, Epinat et al. 2010). The TALE-AvrBs3::FokI and scTrex2::TALE-AvrBs3::FokI constructs were tested in an extrachromosomal assay in mammalian cells (CHO K1) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer" DNA ranging from 5 to 40 bps (SEQ ID NO: 157 to 192, Table 6).

For this assay, CHO K1 cells were transfected in a 96-well plate format with 75 ng of target vector and an increasing quantity of each variant DNA from 0.7 to 25 ng, in the presence of PolyFect reagent (1 µL per well). The total amount of transfected DNA was completed to 125 ng (target DNA, variant DNA, carrier DNA) using an empty vector. Seventy-two hours after transfection, culture medium was removed and 150β1 of lysis/revelation buffer for β-galactosidase liquid assay was added. After incubation at 37° C., optical density was measured at 420 nm. The entire process is performed on an automated Velocity11 BioCel platform (Grizot, Epinat et al. 2009).

Activity levels in mammalian cells on suitable targets for the scTrex2::TALE-AvrBs3::FokI construct were comparable to those of the parent TALE-AvrBs3::FokI molecule, indicating that the extra scTrex2 moiety does not impair the TALEN DNA cleavage function. Assessment of the scTrex2 function is performed in assays suitable for the detection of NHEJ events.

Example 5

Baseline designs for the cTALEN scaffolds are based on established TALE DNA binding domains. Compact TALENs are designed to be as small and efficient as possible. To obtain this goal it may therefore be necessary to enlist "enhancer" domains to bridge the functional gap between compact TALE DNA binding domains and the various catalytic domains. FIG. 6 (A-E) illustrates various non-exhaustive configurations wherein such enhancer domains can be applied. Note that the figure is illustrative only, and N- vs. C-terminal variations are implied (i.e. FIG. 6A can also have an N-terminal enhancer domain and C-terminal catalytic domain). Tables 1 and 2 lists potential enhancer domains that could assist in DNA binding (specific and non-specific contacts).

Enhanced TALENs (cTALENs) are created using functional cTALENS from Example 3. The addition of the enhancer domain is evaluated in our yeast assay (see Example 1). A particular enhancer domain is judged useful if it provides a minimal 5% enhancement in efficiency of the starting cTALEN, more preferably a minimal 10% enhancement, more preferably 20%, more preferably 30%, more preferably 40%, more preferably 50%, again more preferably an enhancement greater than 50%.

Example 5a: TALE::ColE7::TALE Enhanced TALENs

Enhanced TALENs (TALE::CD::TALE), possessing N- and C-terminal TALE DNA binding domains bordering a central DNA cleavage domain, were generated using the sT2 (SEQ ID NO: 135) core scaffold. The layout of this class of compact TALEN is illustrated in FIG. 6B, wherein the N-terminal "enhancer domain" is itself a TALE DNA binding domain. A point-mutant derivative of the ColE7 catalytic domain (pCLS15785, SEQ ID NO: 285) was chosen for the catalytic core of the cTALEN. Two final constructs, TALE-AvrBs3::ColE7_A497::TALE-RagT2-R (pCLS15800, SEQ ID NO: 360, encoding the protein of SEQ ID NO: 453) and TALE-RagT2-R::ColE7_A497::TALE-AvrBs3 (pCLS15801, SEQ ID NO: 361, encoding the protein of SEQ ID NO: 454), were obtained using standard molecular cloning techniques with DNA sequences from sT2 (SEQ ID NO: 135), pCLS15785 (SEQ ID NO: 285), AvrBs3 (SEQ ID NO: 152) and RagT2-R (SEQ ID NO: 271) as templates. All TALE::CD::TALE constructs were sequenced and the inserts transferred to additional vectors as needed (see below).

The final TALE::CD::TALE-based yeast expression plasmids, pCLS12106 (SEQ ID NO: 362) and pCLS12110 (SEQ ID NO: 363, were prepared by restriction and ligation using NcoI and EagI restriction sites to subclone into the pCLS0542 (SEQ ID NO: 156) plasmid. The yeast S. cerevisiae strain FYC2-6A (MATα, trp1Δ63, leu2Δ1, his3Δ200) was transformed using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE::CD::TALE constructs are tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on asymmetric AvrBs3/RagT2-R hybrid targets in order to compare activity with a parent compact TALEN (e.g. pCLS8589, SEQ ID NO: 233), which has activity on targets with a single binding site. In addition, constructs are tested on a target having only a single AvrBs3 or RagT2-R recognition site.

Example 6

To date, all known TAL effectors and derivatives thereof appear to require a T base at positions −1 (FIG. 3) in the recognition sequence. To overcome this limitation, an enhancer domain is used to replace the N-terminal region of the TALE protein. Sequence and structure-based homology modeling of the N-terminal TALE region of bT2 derivatives have yielded three potential candidate proteins (Table 1): (i) Fem-3 binding factor, SEQ ID NO: 4, (FBF1, Puf family of RNA binding proteins) from C. elegans; (ii) artificial alphahelicoidal repeat proteins (αRep), SEQ ID NO: 5 and; (iii) proteins of the Ankyrin super-family. The content and arrangement of secondary structure elements allows for using these models as starting points for enhancer domains that replace the N-terminal region of the TALE protein.

Chimeric proteins are constructed using the analogous regions from one of the 3 candidates mentioned to replace the N-terminal TALE protein region up to the first canonical repeat domain. The new interface is redesigned in silico, using the homology models as guides. This approach can be used to pinpoint the determinants of specificity for the requisite T at position −1 of the target sequence. The replacement enhancer domain should at minimum provide structural integrity to the cTALEN protein. Constructs are evaluated in our yeast assay (see Example 1). A particular enhancer domain is judged useful if it provides a minimal 5% retention in activity of the starting cTALEN in the absence of a T at target position −1, more preferably a minimal 10% retention, more preferably 20%, more preferably 30%, more preferably 40%, more preferably 50%, again more preferably a retention in activity greater than 50%.

Example 7

To generate more suitable and compact scaffolds for cTALENS, the nature of the C-terminal region (beyond the final half-repeat domain) of the TALE protein has been analyzed. Sequence and structure-based homology modeling of the C-terminal TALE region of bT2-derivatives have yielded three potential candidate proteins (Table 1): (i) the hydrolase/transferase of *Pseudomonas aeuriginosa*, SEQ ID NO: 6 (ii) the Polymerase domain from the *Mycobacterium tuberculosis* Ligase D, SEQ ID NO: 7; (iii) initiation factor eIF2 from *Pyrococcus*, SEQ ID NO: 8; (iv) Translation Initiation Factor Aif2betagamma, SEQ ID NO: 9. As in example 6, homology models are used to pinpoint regions for generating possible C-terminal truncations; potential truncation positions include 28, 40, 64, 118, 136, 169, 190 residues remaining beyond the last half-repeat domain. Additionally, homologous regions from the aforementioned proteins can be used to replace the C-terminal domain entirely. Contact prediction programs can be used to identify, starting from the primary sequence of a protein, the pairs of residues that are likely proximal in the 3D space. Such chimeric proteins should provide more stable scaffolds on which to build cTALENs.

Constructs are evaluated in our yeast assay (see Example 1). A particular enhancer domain is judged useful if it provides a minimal 5% retention in activity of the starting cTALEN, more preferably a minimal 10% retention, more preferably 20%, more preferably 30%, more preferably 40%, more preferably 50%, again more preferably a retention in activity greater than 50%.

Example 8

Figure 8A:
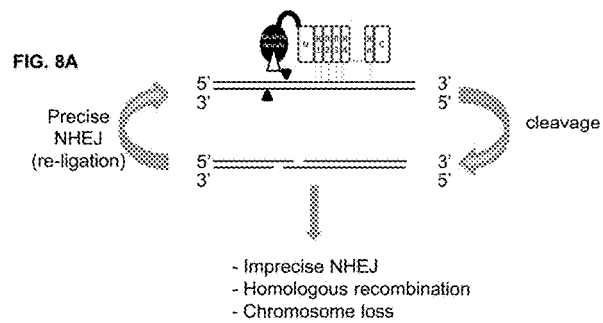
FIG. 8A-E: Schematic of DNA cleavage, in vivo re-ligation and other repair pathways. In cells, cleavage by peptidic rare-cutting endonucleases usually results in a DNA double strand break (DSB) with cohesive ends. For example, meganucleases from the LAGLIDADG family, such as I-SceI and I-CreI, produce DSBs with 3' overhangs. These cohesive ends can be re-ligated in vivo by NHEJ, resulting in seamless repair, and in the restoration of a cleavable target sequence, which can in turn be processed again by the same endonuclease. Thus, a series of futile cycles of cleavage and re-ligation events can take place. Imprecise NHEJ or homologous recombination can alter or remove the cleavage site, resulting in cycle exit; this can also apply to compact TALENs and enhanced compact TALENs according to the present invention (FIG. 8A). Two other ways can also stop the process: (i) Chromosome loss can occur as the consequence of failure to repair the DSB; (ii) a loss of nuclease (degradation, dilution, cell division, etc. . . . ).
Figure 8B:
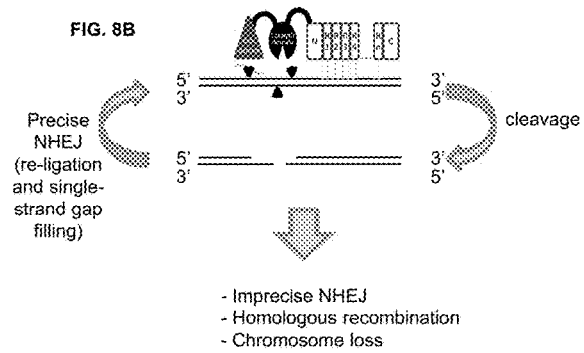
Figure 8C:
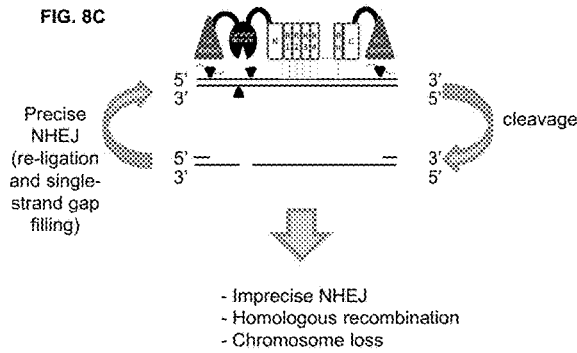
Figure 8D:
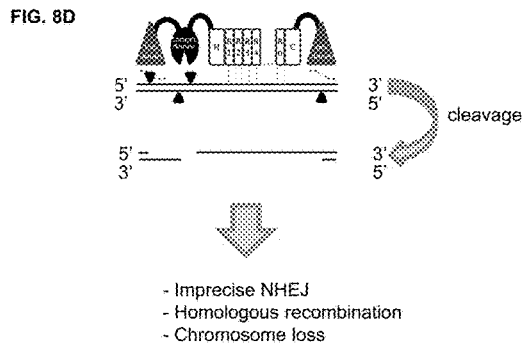
Figure 8E:
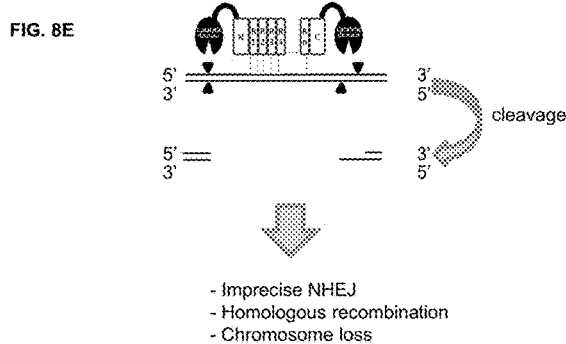

To generate compact TALENS with alternative activities, trans cTALENS are generated by (a) using a catalytic domain with separable activities (FIG. 7A, B), or; (b) providing an auxiliary activity as a TALE-fusion (FIG. 7C). Sequence and structure-based modeling of class III (Chan, Stoddard et al. 2011). TypeIIS restriction endonucleases (REases) were used to create trans TALENs (see Table 2 for a non-exhaustive list). The initial trans TALEN is generated via fusion of an independently active catalytic domain (e.g. the Nt.BspD6I nickase) as described in Examples 3 and 4. In principle this trans TALEN can be used as is depending on the application. To convert the cTALEN to a functional trans TALEN, the auxiliary domain (in this case, ss.BspD6I) is provided in trans (FIG. 8A). Such optionally trans and/or heterodimeric proteins can allow for cTALEN scaffolds with activity that can be modulated to a given application.

Constructs are evaluated in our yeast assay (see Example 1). A particular auxiliary domain is judged useful if it provides an alternative activity to that of the starting cTALEN.

If the auxiliary domain used exhibits activity independent of the initial cTALEN (i.e in a non-trans TALEN context), it can as well be fused to a TALE domain for specific targeting (FIG. 7B). Auxiliary domains can also be provided in trans as targeted entities to provide functions unrelated to the cTALEN (FIG. 7C).

Example 8a: Specific Inhibition of TALEN Catalytic Activity

As mentioned in examples 3c and 3d, both NucA (SEQ ID NO: 26) and ColE7 (SEQ ID NO: 140) can be inhibited by complex formation with their respective inhibitor proteins, NuiA (SEQ ID NO: 229) and Im7 (SEQ ID NO: 230). Colicin-E9 (SEQ ID NO: 366) is another non-limiting example of protein which can be inhibited by its respective inhibitor Im9 (SEQ ID NO: 369). With respect to TALENs derived from the NucA (TALE::NucA) or ColE7 (TALE::ColE7) catalytic domains, the inhibitors serve as auxiliary domains (FIG. 7A) that modulate the activity by preventing DNA cleavage.

The Im7 (SEQ ID NO: 230) and NuiA (SEQ ID NO: 229) inhibitor proteins were subcloned into the pCLS7763 backbone (SEQ ID NO: 241) by restriction and ligation using NcoI and EagI restriction sites, yielding pCLS9922 (SEQ ID NO: 242) and pCLS9923 (SEQ ID NO: 243), respectively. These plasmids were then used in co-transformation experiments in the standard yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

TALE-AvrBs3::NucA (pCLS9924, SEQ ID NO: 223) and TALE-AvrBs3::ColE7 (pCLS8589, SEQ ID NO: 233) constructs were tested in a yeast SSA assay on pseudo palindromic targets in order to compare activity with a standard TALE-AvrBs3::FokI TALEN (pCLS8590, SEQ ID NO: 244), which requires two binding sites for activity. AvrBS3 targets contain two identical recognition sequences juxtaposed with the 3′ ends proximal and separated by "spacer" DNA ranging from 5 to 40 bps (SEQ ID NO: 157 to 192, Table 7). In addition, constructs were tested on a target having only a single AvrBs3 recognition site (SEQ ID NO: 224, Table 7). Activity modulation of the TALENs was assessed in the presence or absence of specific or unspecific inhibitor protein, using the TALE-AvrBs3::FokI TALEN as control.

Data summarized in table 12 indicate that TALE-AvrBs3::NucA and TALE-AvrBs3::ColE7 constructs are specifically inactivated by the presence of their respective inhibitor proteins NuiA and Im7, according to the present invent on.

TABLE 12

Activity of TALEN constructs in the presence of inhibitor protein.

| TALEN Construct | Inhibitor Protein | | |
|---|---|---|---|
| | None | NuiA | Im7 |
| TALE-AvrBs3::NucA (SEQ ID NO: 223) | ++++ | n.d. | ++++ |
| TALE-AvrBs3::ColE7 (SEQ ID NO: 233) | ++++ | ++++ | n.d. |
| TALE-AvrBs3::FokI (SEQ ID NO: 244) | ++++ | ++++ | ++++ |

Relative activity is scaled as:
n.d., no activity detectable;
+, <25% activity;
++, 25% to <50% activity;
+++, 50% to <75% activity;
++++, 75% to 100% activity.

Example 8b: Enhancing TALEN Catalytic Activity Via a Trans TALEN

Example 3b illustrates that the TevI::TALE functions unassisted as a compact TALEN (pCLS8522, SEQ ID NO: 237). To further enhance activity, a trans TALEN was designed using a TALE::TevI construct in a layout depicted in FIG. 7C. The DNA sequence coding for the RVDs to target the RagT2-R site (SEQ ID NO: 271) was subcloned into plasmid pCLS7865-cT11_TevD02 (pCLS9011, SEQ ID NO: 151) using Type IIS restriction enzymes BsmBI for the receiving plasmid and BbvI and SfaNI for the inserted RVD sequence to create the subsequent TALE-RagT2-R::TevI construct cT11RagT2-R_TevD02 (pCLS15802, SEQ ID NO: 364). The construct was sequenced and the insert subcloned into the pCLS7763 backbone (SEQ ID NO: 241) by restriction and ligation using NcoI and EagI restriction sites, yielding pCLS8990 (SEQ ID NO: 365). Plasmid pairs pCLS8522 (SEQ ID NO: 237) and pCLS7763 (SEQ ID NO: 241) or pCLS8522 (SEQ ID NO: 237) and pCLS8990 (SEQ ID NO: 365) were then used in co-transformation experiments in the standard yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-RagT2-R::TevI/TevI::TALE-AvrBs3 construct pairs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on asymmetric RagT2-R/AvrBs3 hybrid targets in order to compare-activity with a parent compact TALEN (e.g. pCLS8522, SEQ ID NO: 237), which has activity on targets with a single binding site. RagT2-R/AvrBs3 hybrid targets contain two different recognition sequences juxtaposed with the 3' end of the first (RagT2-R) proximal to the 5' end of the second (AvrBs3) and separated by "spacer" DNA ranging from 5 to 40 bps (SEQ ID NO: G064 to G099, Table 13). FIG. 18 illustrates the modulation in TevI::TALE-AvrBs3 activity provided by the TALE-RagT2-R::TevI construct, according to the trans cTALEN of the present invention.

Example 9: Replacement of the C-Terminal Domain by a Polypeptide Linker, Activity with colE7 Catalytic Domain We generated a first library of 37 different linkers. Many of them have a common structure comprising a variable region encoding 3 to 28 amino acids residues and flanked by regions encoding SGGSGS stretch (SEQ ID NO: 219) at both the 5' and a 3' end (SEQ ID NO: 372 to 408). These linkers contain XmaI and BamHI restriction sites in their 5' and 3' ends respectively. The linker library is then subcloned in pCLS7183 (SEQ ID NO: 141) via the XmaI and BamHI restriction sites to replace the C-terminal domain of the AvrBs3-derived TALEN (pCLS7184, SEQ ID NO: 196). The AvrBs3-derived set of repeat domains (RVDs) or any other RVD sequences having or lacking the terminal half RVD is cloned in this backbone library. DNA from the library is obtained, after scrapping of the colonies from the Petri dishes, using standard miniprep techniques. The FokI catalytic head is removed using BamHI and EagI restriction enzymes, the remaining backbone being purified using standard gel extraction techniques.

DNA coding for ColE7 catalytic domain (SEQ ID NO: 11) was amplified by the PCR to introduce, at the DNA level, a BamHI (at the 5' of the coding strand) and a EagI (at the 3' of the coding strand) restriction site and, at the protein level, a linker (for example -SGGSGS-stretch, SEQ ID NO: 219) between the C terminal domain library and the catalytic head. After BamHI and EagI digestion and purification, the DNA coding for the different catalytic heads were individually subcloned into the library scaffold previously prepared. DNA from the final library is obtained, after scrapping of the colonies from Petri dishes, using standard miniprep techniques and the resulting libraries are screened in our yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "space" DNA containing 15, 18, 21 and 24 bps (SEQ ID NO: 167, 170, 173 and 176, Table 7). In addition, constructs (SEQ ID NO: 416-419) were tested on a target having only a single AvrBs3 recognition site (SEC ID NO: 224). Data summarized in FIG. 20 show sequences of the linker of a fraction of ColE7 constructs being active on targets having two AvrBs3 recognition sites or only one AvrBs3 recognition site.

LIST OF CITED REFERENCES

Arimondo, P. B., C. J. Thomas, et al. (2006). "Exploring the cellular activity of camptothecin-triple-helix-forming oligonucleotide conjugates." Mol Cell Biol 26(1): 324-33.

Arnould, S., P. Chames, et al. (2006). Engineering of large numbers of highly specific homing endonucleases that induce recombination on novel DNA targets. Journal of Molecular Biology. 355: 443-58.

Arnould, S., P. Chames, et al. (2006). "Engineering of large numbers of highly specific homing endonucleases that induce recombination on novel DNA targets." J Mol Biol 355(3): 443-58.

Arnould, S., C. Delenda, et al. (2011). "The I-CreI meganuclease and its engineered derivatives: applications from cell modification to gene therapy gzq083 [pii] 10.1093/protein/gzq083." *Protein engineering, design &selection: PEDS* 24(1-2): 27-31.

Arnould, S., C. Perez, et al. (2007). "Engineered I-CreI derivatives cleaving sequences from the human XPC gene can induce highly efficient gene correction in mammalian cells." *Journal of Molecular Biology* 371(1): 49-65.

Ashworth, J., J. J. Havranek, et al. (2006). "Computational redesign of endonuclease DNA binding and cleavage specificity." *Nature* 441(7093): 656-9.

Bedayat, B., A. Abdolmohamadi, et al. (2010). "Sequence-specific correction of genomic hypoxanthine-guanine phosphoribosyl transferase mutations in lymphoblasts by small fragment homologous replacement 10.1089/oli.2009.0205." *Oligonucleotides* 20(1): 7-16.

Bennardo, N., A. Cheng, et al. (2008). "Alternative-NHEJ is a mechanistically distinct pathway of mammalian chromosome break repair." *PLoS Genet* 4(6): e1000110.

Bennardo, N., A. Gunn, et al. (2009). "Limiting the persistence of a chromosome break diminishes its mutagenic potential." *PLoS Genet* 5(10): e1000683.

Boch, J., H. Scholze, et al. (2009). "Breaking the code of DNA binding specificity of TAL type III effectors." *Science* 326(5959): 1509-12.

Boch, J., H. Scholze, et al. (2009). "Breaking the code of DNA binding specificity of TAL-type III effectors 1178811 [pii] 10.1126/science.1178811." *Science* 326(5959): 1509-12.

Bolduc, J. M., P. C. Spiegel, et al. (2003). "Structural and biochemical analyses of DNA and RNA binding by a bifunctional homing endonuclease and group I intron splicing factor." *Genes Dev* 17(23): 2875-88.

Buis, J., Y. Wu, et al. (2008). "Mre11 nuclease activity has essential roles in DNA repair and genomic stability distinct from ATM activation." *Cell* 135(1): 85-96.

Capecchi, M. R. (2001). "Generating mice with targeted mutations 10.1038/nm1001-1086 nm1001-1086 [pii]." *Nature Medicine* 7(10): 1086-90.

Carroll, D. (2008). "Progress and prospects: zinc-finger nucleases as gene therapy agents gt2008145 [pii] 10.1038/gt.2008.145." *Gene therapy* 15(22): 1463-8.

Chames, P., J. C. Epinat, et al. (2005). "In vivo selection of engineered homing endonucleases using double-strand break induced homologous recombination." *Nucleic Acids Res* 33(20): e178.

Chames, P., J. C. Epinat, et al. (2005). "In vivo selection of engineered homing endonucleases using double-strand break induced homologous recombination." *Nucleic Acids Research* 33(20): e178.

Chan, S. H., B. L. Stoddard, et al. (2011). "Natural and engineered nicking endonucleases—from cleavage mechanism to engineering of strand-specificity." *Nucleic Acids Research* 39: 1-18.

Chevalier, B., M. Turmel, et al. (2003). "Flexible DNA target site recognition by divergent homing endonuclease isoschizomers I-CreI and I-MsoI." *J Mol Biol* 329(2): 253-69.

Chevalier, B. S., T. Kortemme, et al. (2002). "Design, activity, and structure of a highly specific artificial endonuclease." *Mol Cell* 10(4): 895-905.

Chevalier, B. S., R. J. Monnat, Jr., et al. (2001). "The homing endonuclease I-CreI uses three metals, one of which is shared between the two active sites." *Nat Struct Biol* 8(4): 312-6.

Chevalier, B.S. and B. L. Stoddard (2001). "Homing endonucleases: structural and functional insight into the catalysts gf intron/intein mobility." *Nucleic Acids Res* 29(18): 3757-74.

Choo, Y. and A. Klug (1994). "Selection of DNA binding sites for zinc fingers using rationally randomized DNA reveals coded interactions." *Proceedings of the National Academy of Sciences of the United States of America* 91(23): 11168-72.

Choo, Y. and A. Klug (1994). "Toward a code for the interactions of zinc fingers with DNA: selection of randomized fingers displayed on phage." *Proceedings of the National Academy of Sciences of the United States of America* 91(23): 11163-7.

Choulika, A., A. Perrin, et al. (1995). "Induction of homologous recombination in mammalian chromosomes by using the I-SceI system of *Saccharomyces cerevisiae*." *Mol Cell Biol* 15(4): 1968-73.

Christian, M., T. Cermak, et al. (2010). "Targeting DNA double-strand breaks with TAL effector nucleases." *Genetics* 186(2): 757-61.

Christian, M., T. Cermak, et al. (2010). "Targeting DNA double-strand breaks with TAL effector nucleases genetics.110.120717 [pii] 10.1534/genetics.110.120717." *Genetics* 186(2): 757-61.

Cost, G. J., Y. Freyvert, et al. (2010). "BAK and BAX deletion using zinc-finger nucleases yields apoptosis-resistant CHO cells 10.1002/bit.22541." *Biotechnology and Bioengineering* 105(2): 330-40.

Delacote, F. and B. S; Lopez (2008). "Importance of the cell cycle phase for the choice of the appropriate DSB repair pathway, for genome stability maintenance: the trans-S double-strand break repair model 5149 [pii]." *Cell Cycle* 7(1): 33-8.

Doudeva, L. G., H. Huang, et al. (2006). "Crystal structural analysis and metal-dependent stability and activity studies of the ColE7 endonuclease domain in complex with DNA/Zn2+ or inhibitor/Ni2+ 15/2/269 [pii] 10.1110/ps.051903406." *Protein science: a publication of the Protein Society* 15(2): 269-80.

Doyon, J. B., V. Pattanayak, et al. (2006). "Directed evolution and substrate specificity profile of homing endonuclease I-SceI." *Journal of the American Chemical Society* 128(7): 2477-84.

Doyon, J. B., V. Pattanayak, et al. (2006). "Directed evolution and substrate specificity profile of homing endonuclease I-SceI." *J Am Chem Soc* 128(7): 2477-84.

Doyon, Y., J. M. McCammon, et al. (2008). "Heritable targeted gene disruption in zebrafish using designed zinc-finger nucleases nbt1409 [pii] 10.1038/nbt1409." *Nature Biotechnology* 26(6): 702-8.

Eastberg, J. H., J. Eklund, et al. (2007). "Mutability of an HNH nuclease imidazole general base and exchange of a deprotonation mechanism." *Biochemistry* 46(24): 7215-25.

Eisenschmidt, K., T. Lanio, et al. (2005). "Developing a programmed restriction endonuclease for highly specific DNA cleavage." *Nucleic Acids Res* 33(22): 7039-47.

Elrod-Erickson, M., M. A. Rould, et al. (1996). "Zif268 protein-DNA complex refined at 1.6 A: a model system for understanding zinc finger-DNA interactions." *Structure* 4(10): 1171-80.

Epinat, J. C., S. Arnould, et al. (2003). "A novel engineered meganuclease induces homologous recombination in yeast and mammalian cells." *Nucleic Acids Research* 31(11): 2952-62.

Epinat, J. C., S. Arnould, et al. (2003). "A novel engineered meganuclease induces homologous recombination in yeast and mammalian cell." *Nucleic Acids Res* 31(11): 2952-62.

Frank, K. M., J. M. Sekiguchi, et al. (1998). "Late embryonic lethality and impaired V(D)J recombination in mice lacking DNA ligase IV 10.1038/24172." *Nature* 396 (6707): 173-7.

Galetto, R., P. Duchateau, et al. (2009). "Targeted approaches for gene therapy and the emergence of engineered meganucleases 10.1517/14712590903213669." *Expert opinion on biological therapy* 9(10): 1289-303.

Gao, H., J. Smith, et al. (2010). "Heritable targeted mutagenesis in maize using a designed endonuclease TPJ4041 [pii] 10.1111/j.1365-313X.2009.04041.x." *The Plant journal: for cell and molecular biology* 61(1): 176-87

Gao, Y., Y. Sun, et al. (1998). "A critical role for DNA end-joining proteins in both lymphogenesis and neurogenesis S0092-8674(00)81714-6 [pii]." *Cell* 95(7): 891-902.

Geurts, A. M., G. J. Cost, et al. (2009). "Knockout rats via embryo microinjection of zinc-finger nucleases 325/5939/433 [pii] 10.1126/science.1172447." *Science* 325(5939): 433.

Gimble, F. S., C. M. Moure, et al. (2003). "Assessing the plasticity of DNA target site recognition of the PI-SceI homing endonuclease using a bacterial two-hybrid selection system." *J Mol Biol* 334(5): 993-1008.

Greisman, H. A. and C. O. Pabo (1997). "A general strategy for selecting high-affinity zinc finger proteins for diverse DNA target sites." *Science* 275(5300): 657-61.

Gruenert, D. C., E. Bruscia, et al. (2003). "Sequence-specific modification of genomic DNA by small DNA fragments 10.1172/JCI19773 112/5/637 [pii]." *The Journal of clinical investigation* 112(5): 637-41.

Guirouilh-Barbat, J., S. Huck, et al. (2004). "Impact of the KU80 pathway on NHEJ-induced genome rearrangements in mammalian cells." *Mol Cell* 14(5): 611-23.

Guirouilh-Barbat, J., S: Huck, et al. (2004). "Impact of the KU80 pathway on NHEJ-induced genome rearrangements in mammalian cells 10.1016/j.molcel.2004.05.008 S1097276504002916 [pii]." *Molecular Cell* 14(5): 611-23.

Guirouilh-Barbat, J., E. Rass, et al. (2007). "Defects in XRCC4 and KU80 differentially affect the joining of distal nonhomologous ends." *Proc Natl Acad Sci USA* 104(52): 20902-7.

Guirouilh-Barbat, J., E. Rass, et al. (2007). "Defects in XRCC4 and KU80 differentially affect the joining of distal nonhomologous ends 0708541104 [pii] 10.1073/pnas.0708541104." *Proceedings of the National Academy of Sciences of the United States of America* 104(52): 20902-7.

Gurlebeck, D., B. Szurek, et al. (2005). "Dimerization of the bacterial effector protein AvrBs3 in the plant cell cytoplasm prior to nuclear import TPJ2370 [pii] 10.1111/j.1365-313X.2005.02370.x." *The Plant journal: for cell and molecular biology* 42(2): 175-87.

Haber, J. (2000). "Partners and pathways repairing a double-strand break." *Trends Genet.* 16(6): 259-264.

Haber, J. E. (2008). "Alternative endings 0711334105 [pii] 10.1073/pnas.0711334105." *Proceedings of the National Academy of Sciences of the United States of America* 105(2): 405-6.

Hartsuiker, E., K. Mizuno, et al. (2009). "Ctp1CtIP and Rad32Mre11 nuclease activity are required for Rec12Spo11 removal, but Rec12Spo11 removal is dispensable for other MRN-dependent meiotic functions." *Mol Cell Biol* 29(7): 1671-81.

Hinnen, A., J. B. Hicks, et al. (1978). "Transformation of yeast." *Proceedings of the National Academy of Sciences of the United States of America* 75(4): 1929-33.

Hirata, R., J. Chamberlain, et al. (2002). "Targeted transgene insertion into human chromosomes by adeno-associated virus vectors 10.1038/nbt0702-735 nbt0702-735 [pii]." *Nature Biotechnology* 20(7): 735-8.

Huang, H. and H. S. Yuan (2007). "The conserved asparagine in the HNH motif serves an important structural role in metal finger endonucleases." *Journal of Molecular Biology* 368(3): 812-21.

Ichiyanagi, K., Y. Ishino, et al. (2000). "Crystal structure of an archaeal intein-encoded homing endonuclease PI-PfuI." *J Mol Biol* 300(4): 889-901.

Inoue, N., R. Dong, et al. (2001). "Introduction of single base substitutions at homologous chromosomal sequences by adeno-associated virus vectors 10.1006/mthe.2001.0283 S1525-0016(01)90283-7 [pii]." *Molecular therapy: the journal of the American Society of Gene Therapy* 3(4): 526-30.

Isalan, M. and Y. Choo (2001). "Rapid, high-throughput engineering of sequence-specific zinc finger DNA-binding proteins S0076-6879(01)40444-7 [pii]." *Methods in Enzymology* 340: 593-609.

Kalish, J. M. and P. M. Glazer (2005). "Targeted genome modification via triple helix formation." *Ann NY Acad Sci* 1058: 151-61.

Kim, H. J., H. J. Lee, et al. (2009). "Targeted genome editing in human cells with zinc finger nucleases constructed v a modular assembly gr.089417.108 [pii] 10.1101/gr.089417.108." *Genome Research* 19(7): 1279-88.

Kim, Y. G., J. Cha, et al. (1996). "Hybrid restriction enzymes: zinc finger fusions to Fok I cleavage domain." *Proceedings of the National Academy of Sciences of the United States of America* 93(3): 1156-60.

Ku, W. Y., Y. W. Liu, et al. (2002). "The zinc ion in the HNH motif of the endonuclease domain of colicin E7 is not required for DNA binding but is essential for DNA hydrolysis." *Nucleic Acids Research* 30(7): 1670-8.

Landthaler, M., U. Begley, et al. (2002). "Two self-splicing group I introns in the ribonucleotide reductase large subunit gene of *Staphylococcus aureus* phage Twort." *Nucleic Acids Research* 30(9): 1935-43.

Landthaler, M., N. C. Lau, et al. (2004). "Group I intron homing in *Bacillus* phages SPO1 and SP82: a gene conversion event initiated by a nicking homing endonuclease." *Journal of Bacteriology* 186(13): 4307-14.

Landthaler, M., B. W. Shen, et al. (2006). "I-BasI and I-HmuI: two phage intron-encoded endonucleases with homologous DNA recognition sequences but distinct DNA specificities." *Journal of Molecular Biology* 358(4): 1137-51.

Landthaler, M. and D. A. Shub (2003). "The nicking homing endonuclease I-BasI is encoded by a group I intron in the DNA polymerase gene of the *Bacillus thuringiensis* phage Bastille." *Nucleic Acids Research* 31(12): 3071-7.

Lee, S. E., F. Paques, et al. (1999). "Role of yeast SIR genes and mating type in directing DNA double-strand breaks to homologous and non-homologous repair paths." *Curr Biol* 9(14): 767-70.

Li, T., S. Huang, et al. s2010). "TAL nucleases (TALNs): hybrid proteins composed of TAL effectors and FokI DNA-cleavage domain." *Nucleic Acids Res* 39(1): 359-72.

Li, T., S. Huang, et al. (2011). "TAL nucleases (TALNs): hybrid proteins composed of TAL effectors and FokI DNA-cleavage domain gkq704 [pii] 10.1093/nar/gkq704." *Nucleic Acids Research* 39(1): 359-72.

Liang, F., M. Han, et al. (1998). "Homology-directed repair is a major double-strand break repair pathway in mammalian cells." *Proceedings of the National Academy of Sciences of the United States of America* 95(9): 5172-7.

Liu, P. Q., E. M. Chan, et al. (2010). "Generation of a triple-gene knockout mammalian cell line using engineered zinc-finger nucleases 10.1002/bit.22654." *Biotechnology and Bioengineering* 106(1): 97-105.

Liu, Q., J. T. Dansereau, et al. (2008). "Role of the inter-domain linker in distance determination for remote cleavage by homing endonuclease I-TevI." *J Mol Biol* 379(5): 1094-106.

Liu, Q., V. Derbyshire, et al. (2006). "Distance determination by GIY-YIG intron endonucleases: discrimination between repression and cleavage functions." *Nucleic Acids Research* 34(6): 1755-64.

Lloyd, A., C. L. Plaisier; et al. (2005). "Targeted mutagenesis using zinc-finger nucleases in *Arabidopsis* 0409339102 [pii] 10.1073/pnas.0409339102." *Proceedings of the National Academy of Sciences of the United States of America* 102(6): 2232-7.

Maeder, M. L., S. Thibodeau-Beganny, et al. (2008). "Rapid "open-source" engineering of customized zinc-finger nucleases for highly efficient gene modification S1097-2765(08)00461-9 [pii] 10.1016/j.molcel.2008.06.016." *Molecular Cell* 31(2): 294-301.

Mahfouz, M. M., L. Li, et al. (2011). "De novo-engineered transcription activator-like effector (TALE) hybrid nuclease with novel DNA binding specificity creates double-strand breaks 1019533108 [pii] 10.1073/pnas.1019533108." *Proceedings of the National Academy of Sciences of the United States of America* 108(6): 2623-8.

Marcaida, M. J., I. G. Munoz, et al. (2010). "Homing endonucleases: from basics to therapeutic applications 10.1007/s00018-009-0188-y." *Cellular and molecular life sciences: CMLS* 67(5): 727-48.

Mashimo, T., A. Takizawa, et al. (2010). "Generation of knockout rats with X-linked severe combined immunodeficiency (X-SCID) using zinc-finger nucleases 10.1371/journal.pone.0008870." *PLoS one* 5(1): e8870.

McConnell Smith, A., R. Takeuchi, et al. (2009). "Generation of a nicking enzyme that stimulates site-specific gene conversion from the I-AniI LAGLIDADG homing endonuclease 0810588106 [pii] 10.1073/pnas.0810588106." *Proceedings of the National Academy of Sciences of the United States of America* 106(13): 5099-104.

McVey, M. and S. E. Lee (2008). "MMEJ repair of double-strand breaks (director's cut): deleted sequences and alternative endings S0168-9525(08)00229-1 [pii] 10.1016/j.tig.2008.08.007." *Trends in genetics: TIG* 24(11): 529-38.

Menoret, S., A. L. Iscache, et al. (2010). "Characterization of immunoglobulin heavy chain knockout rats 10.1002/eji.201040939." *European Journal of Immunology* 40(10): 2932-41.

Metzger, M. J., A. McConnell-Smith, et al. (2011). "Single-strand nicks induce homologous recombination with less toxicity than double-strand breaks using an AAV vector template gkq826 [pii] 10.1093/nar/gkq826." *Nucleic Acids Research* 39(3): 926-35.

Midon, M., P. Schafer, et al. (2011). "Mutational and biochemical analysis of the DNA-entry nuclease EndA from *Streptococcus pneumoniae* gkq802 [pii] 10.1093/nar/gkq802." *Nucleic Acids Research* 39(2): 623-34.

Miller, J. C., S. Tan, et al. (2011). "A TALE nuclease architecture for efficient genome editing nbt.1755 [pii] 10.1038/nbt.1755." *Nature Biotechnology* 29(2): 143-8.

Mimitou, E. P. and L. S. Symington (2008). "Sae2, Exo1 and Sgs1 collaborate in DNA double-strand break processing." *Nature* 455(7214): 770-4.

Moore, I., M. Samalova, et al. (2006). "Transactivated and chemically inducible gene expression in plants." *Plant J* 45(4): 651-83.

Moore, J. K. and J. E. Haber (1996). "Cell cycle and genetic requirements of two pathways of nonhomologous end-joining repair of double-strand breaks in *Saccharomyces cerevisiae*." *Mol Cell Biol* 16(5): 2164-73.

Moscou, M. J. and A. J. Bogdanove (2009). "A simple cipher governs DNA recognition by TAL effectors." *Science* 326(5959): 1501.

Moscou, M. J. and A. J. Bogdanove (2009). "A simple cipher governs DNA recognition byTAL effectors 1178817 [pii] 10.1126/science.1178817." *Science* 326(5959): 1501.

Moure, C. M., F. S. Gimble, et al. (2002). "Crystal structure of the intein homing endonuclease PI-SceI bound to its recognition sequence." *Nat Struct Biol* 9(10): 764-70.

Moure, C. M., F. S. Gimble, et al. (2003). "The crystal structure of the gene targeting homing endonuclease I-SceI reveals the origins of its target site specificity." *J Mol Biol* 334(4): 685-95.

Nimonkar, A. V., J. Genschel, et al. (2011). "BLM=DNA2-RPA-MRN and EXO1-BLM-RPA-MRN constitute two DNA end resection machineries for human DNA break repair." *Genes Dev* 25(4): 350-62.

Niu, Y., K. Tenney, et al. (2008). "Engineering variants of the I-SceI homing endonuclease with strand-specific and site-specific DNA-nicking activity S0022-2836(08)00840-1 [pii] 10.1016/j.jmb.2008.07.010." *Journal of Molecular Biology* 382(1): 188-202.

Orr-Weaver, T. L., J. W. Szostak, et al. (1981). "Yeast transformation: a model system for the study of recombination." *Proceedings of the National Academy of Sciences of the United States of America* 78(16): 6354-8.

Orr-Weaver, T. L., J. W. Szostak, et al. (1983). "Genetic applications of yeast transformation with linear and gapped plasmids." *Methods in Enzymology* 101: 228-45.

Pabo, C. O., E. Peisach, et al. (2001). "Design and selection of novel Cys2His2 zinc finger proteins 70/1/313 [pii] 10.1145/annurev.biochem.70.1.313." *Annual Review of Biochemistry* 70: 313-40.

Padidam, M. (2003). "Chemically regulated gene expression in plants." *Curr Opin Plant Biol* 6(2): 169-77.

Paques, F. and P. Duchateau (2007). "Meganucleases and DNA double-strand break-induced recombination: perspectives for gene therapy." *Current Gene Therapy* 7(1): 49-66.

Paques, F. and P. Duchateau (2007). "Meganucleases and DNA double-strand break-induced recombination: perspectives for gene therapy." *Curr Gene Ther* 7(1): 49-66.

Paques, F. and J. E. Haber (1999). "Multiple pathways of recombination induced by double-strand breaks in *Saccharomyces cerevisiae*." *Microbiology and molecular biology reviews: MMBR* 63(2): 349-404.

Perez, E. E., J. Wang, et al. (2008). "Establishment of HIV-1 resistance in CD4+ T cells by genome editing using zinc-finger nucleases nbt1410 [pii] 10.1038/nbt1410." *Nature Biotechnology* 26(7): 808-16.

Pierce, A. J., P. Hu, et al. (2001). "Ku DNA end-binding protein modulates homologous repair of double-strand breaks in mammalian cells." *Genes Dev* 15(24): 3237-42.

Pingoud, A. and G. H. Silva (2007). "Precision genome surgery." *Nat Biotechnol* 25(7): 743-4.

Porteus, M. H. and D. Carroll (2005). "Gene targeting using zinc finger nucleases." *Nat Biotechnol* 23(8): 967-73.

Ramirez, C. L., J. E. Foley, et al. (2008). "Unexpected failure rates for modular assembly of engineered zinc fingers nmeth0508-374 [pii] 10.1038/nmeth0508-374." *Nature Methods* 5(5): 374-5.

Rosen, L. E., H. A. Morrison, et al. (2006). "Homing endonuclease I-CreI derivatives with novel DNA target specificities." *Nucleic Acids Research* 34(17): 4791-800.

Rosen, L. E., H. A. Morrison, et al. (2006). "Homing endonuclease I-CreI derivatives with novel DNA target specificities." *Nucleic Acids Res*.

Rothstein, R. J. (1983). "One-step gene disruption in Yeast." *Methods in Enzymology* 101: 202-11.

Rouet, P., F. Smih, et al. (1994). "Expression of a site-specific endonuclease stimulates homologous recombination in mammalian cells." *Proc Natl Acad Sci USA* 91(13): 6064-8.

Rouet, P., F. Smih, et al. (1994). "Introduction of double-strand breaks into the genome of mouse cells by expression of a rare-cutting endonuclease." *Mol Cell Biol* 14(12): 8096-106.

Russell, D. W. and R. K. Hirata (1998). "Human gene targeting by viral vectors 10.1038/ng0498-325." *Nature Genetics* 18(4): 325-30.

Sangiuolo, F., M. L. Scaldaferri, et al. (2008). "Cftr gene targeting in mouse embryonic stem cells mediated by Small Fragment Homologous Replacement (SFHR) 2904 [pii]." *Frontiers in bioscience: a journal and virtual library* 13: 2989-99.

Santiago, Y., E. Chan, et al. (2008). "Targeted gene knockout in mammalian cells by using engineered zinc-finger nucleases 0800940105 [pii] 10.1073/pnas.0800940105." *Proceedings of the National Academy of Sciences of the United States of America* 105(15): 5809-14.

Sartori, A. A., C. Lukas, et al. (2007). "Human CtIP promotes DNA end resection." *Nature* 450(7169): 509-14.

Seligman, L. M., K. M. Chisholm, et al. (2002). "Mutations altering the cleavage specificity of a homing endonucleases" *Nucleic Acids Research* 30(17): 3870-9.

Seligman, L. M., K. M. Stephens, et al. (1997). "Genetic analysis of the *Chlamydomonas reinhardtii* I-CreI mobile intron homing system in *Escherichia coli.*" *Genetics* 147(4): 1653-64.

Shen, B. W., M. Landthaler, et al. (2004). "DNA binding and cleavage by the HNH homing endonuclease I-HmuI." *Journal of Molecular Biology* 342(1): 43-56.

Shukla, V. K., Y. Doyon, et al. (2009). "Precise genome modification in the crop species *Zea mays* using zinc-finger nucleases nature07992 [pii] 10.1038/nature07992." *Nature* 459(7245): 437-41.

Silva, G. H., J. Z. Dalgaard, et al. (1999). "Crystal structure of the thermostable archaeal intron-encoded endonuclease I-DmoI." *J Mol Biol* 286(4): 1123-36.

Simon, P., F. Cannata, et al. (2008). "Sequence-specific DNA cleavage mediated by bipyridine polyamide conjugates." *Nucleic Acids Res* 36(11): 3531-8.

Smith, J., J. M. Berg, et al. (1999). "A detailed study of the substrate specificity of a chimeric restriction enzyme gkc139 [pii]." *Nucleic Acids Research* 27(2): 674-81.

Smith, J., M. Bibikova, et al. (2000). "Requirements for double-strand cleavage by chimeric restriction enzymes with zinc finger DNA-recognition domains." *Nucleic Acids Research* 28(17): 3361-9.

Smith, J., S. Grizot, et al. (2006). "A combinatorial approach to create artificial homing endonucleases cleaving chosen sequences." *Nucleic Acids Research* 34(22): e149.

Smith, J., S. Grizot, et al. (2006). "A combinatorial approach to create artificial homing endonucleases cleaving chosen sequences." *Nucleic Acids Res* 34(22): e149.

Sonoda, E., H. Hochegger, et al. (2006). "Differential usage of non-homologous end-joining and homologous recombination in double strand break repair." *DNA Repair (Amst)* 5(9-10): 1021-9.

Spiegel, P. C., B. Chevalier, et al. (2006). "The structure of I-CeuI homing endonuclease: Evolving asymmetric bNA recognition from a symmetric protein scaffold." *Structure* 14(5): 869-80.

Stoddard, B. L. (2005). "Homing endonuclease structure and function." *Quarterly Reviews of Biophysics* 38(1): 49-95.

Stoddard, B. L. (2005). "Homing endonuclease structure and function." *Q Rev Biophys* 38(1): 49-95.

Stoddard, B. L., A. M. Scharenberg, et al. (2007). Advances in Engineering Homing Endonucleases for Gene Targeting: Ten Years After Structures. *Progress in Gene Therapy: Autologous and Cancer Stem Cell Gene Therapy*. R. Bertolotti and K. Ozawa, World Scientific Publishing Co. Pte. Ltd. 3: 135-68.

Sugawara, N. and J. E. Haber (1992). "Characterization of double-strand break-induced recombination: homology requirements and single-stranded DNA formation." *Mol Cell Biol* 12(2): 563-75.

Sun, H., D. Treco, et al. (1991). "Extensive 3'-overhanging, single-stranded DNA associated with the meiosis-specific double-strand breaks at the ARG4 recombination initiation site." *Cell* 64(6): 1155-61.

Sussman, D., M. Chadsey, et al. (2004). "Isolation and characterization of new homing endonuclease specificities at individual target site positions." *Journal of Molecular Biology* 342(1): 31-41.

Sussman, D., M. Chadsey, et al. (2004). "Isolation and characterization of new homing endonuclease specificities at individual target site positions." *J Mol Biol* 342(1): 31-41.

Taubes, G. (2002). "Gene therapy. The strange case of chimeraplasty 10.1126/science.298.5601.2116 298/5601/2116 [pii]." *Science* 298(5601): 2116-20.

Wang, R., X. Zhou, et al. (2003). "Chemically regulated expression systems and their applications in transgenic plants." *Transgenic Res* 12(5): 529-40.

Wang, Y. T., J. D. Wright, et al. (2009). "Redesign of high-affinity nonspecific nucleases with altered sequence preference 10.1021/ja907160r." *Journal of the American Chemical Society* 131(47): 17345-53.

White, C. I. and J. E. Haber (1990). "Intermediates of recombination during mating type switching in *Saccharomyces cerevisiae.*" *Embo J* 9(3): 663-73.

Yang, M., V. Djukanovic, et al. (2009). "Targeted mutagenesis in the progeny of maize transgenic plants 10.1007/s11103-009-9499-5." *Plant Molecular Biology* 70(6): 669-79.

Zhao, L., R. P. Bonocora, et al. (2007). "The restriction fold turns to the dark side: a bacterial homing endonuclease with a PD-(D/E)-XK motif." *The EMBO Journal* 26(9): 2432-42.

Zuo, J. and N. H. Chua (2000). "Chemical-inducible systems for regulated expression of plant genes." *Curr Opin Biotechnol* 11(2): 146-51.

SEQUENCE LISTING (470 sequences)

SEQ ID NO: 1 - protein, 163 aa, Chlamydomonas reinhardtii
MNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 2 - DNA, 22 bp, Artificial
  C1221 target
caaaacgtcgtacgacgttttg

SEQ ID NO: 3 - DNA, 22 bp, Artificial
  C1234 target
caaaacgtcgtgagacagtttg

SEQ ID NO: 4 - protein, 412 aa, artificial sequence
  fem-3 gi|262368139|pdb|3K5Q|
SNNVLPTWSLDSNGEMRSRLSLSEVLDSGDLMKFAVDKTGCQFLEKAVKGSLTSYQKFQLFEQVIGRKDDFLKLSTNIFGNYLVQSVIGISLATNDDGYTKRQEKLKNFISSQMTDMCLDKFACRVIQSSLQNMDLSLACKLVQALPRDARLIAICVDQNANHVIQKVVAVIPLKNWEFIVDFVATPEHLRQICSDKYGCRVVQTIIEKLTADSMNVDLTSAAQNLRERALQRLMTSVTNRCQELATNEYANYIIQHIVSNDDLAVYRECIIEKCLMRNLLSLSQEKFASHVVEKAFLHAPLELLAEMMDEIFDGYIPHPDTGKDALDIMMFHQFGNYVVQCMLTICCDAVSGRRQTKEGGYDHAISFQDWLKKLHSRVTKERHRLSRFSSGKKMIETLANLRSTHPIYELQ

SEQ ID NO: 5 - protein, 201 aa, artificial sequence
  aRep gi|308387836|pdb|3LTJ|
MRGSHHHHHHTDPEKVEMYIKNLQDDSYYVRRAAAYALGKIGDERAVEPLIKALKDEDAWVRRAAADALGQIGDERAVEPLIKALKDEDGWVRQSAAVALGQIGDERAVEPLIKALKDEDWFVRIAAAFALGEIGDERAVEPLIKALKDEDGWVRQSAADALGEIGGERVRAAMEKLAETGTGFARKVAVNYLETHKSLIS

SEQ ID NO: 6 - protein, 309 aa, Pseudomonas Aeruginosa
  Ligd Polymerase Domain gi|109157579|pdb|2FAO|
MGARKASAGASRAATAGVRISHPQRLIDPSIQASKLELAEFHARYADLLLRDLRERPVSLVRGPDGIGGELFFQKHAARLKIPGIVQLDPALDPGHPPLLQIRSAEALVGAVQMGSIEFHTWNASLANLERPDRFVLDLDPDPALPWKRMLEATQLSLTLLDELGLRAFLKTSGGKGMHLLVPLERRHGWDEVKDFAQAISQHLARLMPERFSAVSGPRNRVGKIFVDYLRNSRGASTVAAYSVRAREGLPVSVPVFREELDSLQGANQWNLRSLPQRLDELAGDDPWADYAGTRQRISAAMRRQLGRG

SEQ ID NO: 7 - protein, 303 aa, Mycobacterium Tuberculosis
  Ligase D 2R9L_A GI: 164519498
GSHMGSASEQRVTLTNADKVLYPATGTTKSDIFDYYAGVAEVMLGHIAGRPATRKRWPNGVDQPAFFEKQLALSAPPWLSRATVAHRSGTTTYPIIDSATGLAWIAQQAALEVHVPQWRFVAEPGSGELNPGPATRLVFDLDPGEGVMMAQLAEVARAVRDLLADIGLVTFPVTSGSKGLHLYTPLDEPVSSRGATVLAKRVAQRLEQAMPALVTSTMTKSLRAGKVFVDWSQNSGSKTTIAPYSLRGRTHPTVAAPRTWAELDDPALRQLSYDEVLTRIARDGDLLERLDADAPVADRLTRY

SEQ ID NO: 8 - protein, 410 aa, Pyrococcus Abyssi
  Large Gamma Subunit Of Initiation Factor Eif2 1KJZ_A  GI:20664108
GEKRKSRQAEVNIGMVGHVDHGKTTLTKALTGVWTDTHSEELRRGITIKIGFADAEIRRCPNCGRYSTSPVCPYCGHETEFVRRVSFIDAPGHEALMTTMLAGASLMDGAILVIAANEPCPRPQTREHLMALQIIGQKNIIIAQNKIELVDKEKALENYRQIKEFIEGTVAENAPIIPISALHGANIDVLVKAIEDFIPTPKRDPNKPPKMLVLRSFDVNKPGTPPEKLVGGVLDGSIVQGKLKVGDEIEIRPGVPYEEHGRIKYEPITTEIVSLQAGGQFVEEAYPGGLVGVGTKLDPYLTKGDLMAGNVVGKPGKLPPVWDSLRLEVHLLERVVGTEQELKVEPIKRKEVLLLNVGTARTMGLVTGLGKDEIEVKLQIPVCAEPGDRVAISRQIGSRWRLIGYGIIKE

SEQ ID NO: 9 - protein, 419 aa, artificial sequence
  Translation Initiation Factor Aif2betagamma 2D74_A  GI:112490420
MGEKRKTRQAEVNIGMVGHVDHGKTTLTKALTGVWTDTHSEELRRGITIKIGFADAEIRRCSNCGRYSTSPICPYCGHETEFIRRVSFIDSPGHEALMTTMLAGASLMDGAILVIAANEPCPRPQTREHLMALQIIGQKNIIIAQNKIELVDKEKALENYRQIKEFIKGTVAENAPIIPISALHGANIDVLVKAIEEFIPTPKRDSNKPPKMLVLRSFDVNKPGTPPEKLVGGVLDGSIVQGKLKVGDEIEIRPGVPYEEHGRIKYEPITTEIVSLQAGGQFVEEAYPGGLVGIGTKLDPYLTKGDLMAGNVVGKPGKLPPVWTDLRLEVHLLERVVGTEQELNVEPIKRKEVLLLNVGTARTMGLVTALGKDEIELKLQIPVCAEPGERVAISRQIGSRWRLIGYGIIKELEHHHHHH

SEQ ID NO: 10 - protein, 919 aa, Methylophilus methylotrophus
  MmeI ACC85607.1
MALSWNEIRRKAIEFSKRWEDASDENSQAKPFLIDFFEVFGITNKRVATFEHAVKKFAKAHKEQSRGFVDLFWPGILLIEMKSRGKDLDKAYDQALDYFSGIAERDLPRYVLVCDFQRFRLTDLITKESVEFLLKDLYQNVRSFGFIAGYQTQVIKPQDPINIKAAERMGKLHDTLKLVGYEGHALELYLVRLLFCLFAEDTTIFEKSLFQEYIETKTLEDGSDLAHHINTLFYVLNTPEQKRLKNLDEHLAAFPYINGKLFEEPLPPAQFDKAMREALLDLCSLDWSRISPAIFGSLFQSIMDAKKRRNLGAHYTSEANILKLIKPLFLDELWVEFEKVKNNKNKLLAFHKKLRGLTFFDPACGCGNFLVITYRELRLLEIEVLRGLHRGGQQVLDIEHLIQINVDQFFGIEIEEFPAQIAQVALWLTDHQMNMKISDEFGNYFARIPLKSTPHILNANALQIDWNDVLEAKKCCFILGNPPFVGKSKQTPGQKADLLSVFGNLKSASDLDLVAAWYPKAAHYIQTNANIRCAFVSTNSITQGEQVSLLWPLLLSLGIKINFAHRTFSWTNEASGVAAVHCVIIGFGLKDSDEKIIYEYESINGEPLAIKAKNINPYLRDGVDVIACKRQQPISKLPSMRYGNKPTDDGNFLFTDEEKNQFITNEPSSEKYFRRFVGGDEFINNTSRWCLWLDGADISEIRAMPLVLARIKKVQEFRLKSSAKPTRQSASTPMKFFYISQPDTDYLLIPETSSENRQFIPIGFVDRNVISSNATYHIPSAEPLIFGLLSSTMHNCWMRNVGGRLESRYRYSASLVYNTFPWIQPNEKQSKAIEEAAFAILKARSNYPNESLAGLYDPKTMPSELLKAHQKLDKAVDSVYGFKGPNTEIARIAFLFETYQKMTSLLPPEKEIKKSKGKN

SEQ ID NO: 11 - protein, 576 aa, Escherichia coli
  Colicin-E7 (CEA7_ECOLX) Q47112.2
MSGGDGRGHNSGAHNTGGNINGGPTGLGGNGGASDGSGWSSENNPWGGGSGSGVHWGGGSGHGNGGGNSNSGGGSNSSVAAPMAFGFPALAAPGAGTLGISVSGEALSAAIADIFAALKGPFKFSAWGIALYGILPSEIAKDDPNMMSKIVTSLPAETVTNVQVSTLPLDQATVSVTKRVTDVVKDTRQHIAVVAGVPMSVPVVNAKPTRTPGVFHASFPGVPSLTVSTVKGLPVSTTLPRGITEDKGRTAVPAGFTFGGGSHEAVIRFPKESGQKPVYVSVTDVLTPAQVKQRQDEEKRLQQEWNDAHPVEVAERNYEQARAELNQANKDVARNQERQAKAVQVYNSRKSELDAANKTLADAKAEIKQFERFAREPMAAGHRMWQMAGLKAQRAQTDVNNKKAAFDAAAKEKSDADVALSSALERRKQKENKEKDAKAKLDKESKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGK

SEQ ID NO: 12 - protein, 274 aa, Streptococcus pneumoniae [sequence omitted]

SEQ ID NO: 13 - protein, 235 aa, Escherichia coli
  Endo I (END1_ECOLI) P25736.1
MYRYLSIAAVVLSAAFSGPALAEGINSFSQAKAAAVKVHADAPGTFYCGCKINWQGKKGVVDLQSCGYQVRKNENRASRVEWEHVVPAWQFGHQRQCWQDGGRKNCAKDPVYRKMESDMHNLQPSVGEVNGDRGNFMYSQWNGGEGQYGQCAMKVDFKEKAAEPPARARGAIARTYFYMRDQYNLTLSRQQTQLFNAWNKMYPVTDWECERDERIAKVQGNHNPYVQRACQARKS

SEQ ID NO: 14 - protein, 297 aa, Homo sapiens
  Human Endo G (NUCG_HUMAN) Q14249.4
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 15 - protein, 299 aa, Bos taurus
  Bovine Endo G (NUCG_BOVIN) P38447.1
MQLLRAGLTLALGAGLGAAAESWWRQRADARATPGLLSRLPVLPVAAAAGLPAVPGAPAGGGPGELAKYGLPGVAQLKSRASYVLCYDPRTRGALWVVEQLRPEGLRGDGNRSSCDFHEDDSVHAYHRATNADYRGSGFDRGHLAAAANHRWSQKAMDDTFYLSNVAPQVPHLNQNAWNNLEKYSRSLTRTYQNVYVCTGPLFLPRTEADGKSYVKYQVIGKNHVAVPTHFFKVLILEAAGGQIELRSYVMPNAPVDEAIPLEHFLVPIESIERASGLLFVPNILARAGSLKAITAGSK

SEQ ID NO: 16 - protein, 247 aa, Haemophilus influenzae
  R.HinP1I AAW33811.1
MNLVELGSKTAKDGFKNEKDIADRFENWKENSEAQDWLVTMGHNLDEIKSVKAVVLSGYKSDINVQVLVFYKDALDIHNIQVKLVSNKRGFNQIDKHWLAHYQEMWKFDDNLLRILRHFTGELPPYHSNTKDKRRMFMTEFSQEEQNIVLNWLEKNRVLVLTDILRGRGDFAAEWVLVAQKVSNNARWILRNINEVLQHYGSGDISLSPRGSINFGRVTIQRKGGDNGRETANMLQFKIDPTELFDI

SEQ ID NO: 17 - protein, 188 aa, Bacillus phage Bastille
  I-BasI AAO93095.1
MFQEEWKDVTGFEDYYEVSNKGRVASKRTGVIMAQYKINSGYLCIKFTVNKKRTSHLVHRLVAREFCEGYSPELDVNHKDTDRMNNNYDNLEWLTRADNLKDVRERGKLNTHTAREALAKVSKKAVDVYTKDGSEYIATYPSATEAAEALGVQGAKISTVCHGKRQHTGGYHFKFNSSVDPNRSVSKK

SEQ ID NO: 18 - protein, 266 aa, Bacillus mojavensis
  I-BmoI AAK09365.1
MKSGVYKITNKNTGKFYIGSSEDCESRLKVHFRNLKNNRHINRYLNNSFNKHGEQVFIGEVIHILPIEEAIAKEQWYIDNFYEEMYNISKSAYHGGDLTSYHPDKRNIILKRADSLKKVYLKMTSEEKAKRWQCVQGENNPMFGRKHTETTKLKISNHNKLYYSTHKNPFKGKKHSEESKTKLSEYASQRVGEKNPFYGKTHSDEFKTYMSKKFKGRKPKNSRPVIIDGTEYESATEASRQLNVVPATILHRIKSKNEKYSGYFYK

SEQ ID NO: 19 - protein, 174 aa, Bacillus phage SP-01
  I-HmuI P34081.1 (HMUI_BPSP1)
MEWKDIKGYEGHYQVSNTGEVYSIKSGKTLKHQIPKDGYHRIGLFKGGKGKTFQVHRLVAIHFCEGYEEGLVVDHKDGNKDNNLSTNLRWVTQKINVENQMSRGTLNVSKAQQIAKIKNQKPIIVISPDGIEKEYPSTKCACEELGLTRGKVTDVLKGHRIHHKGYTFRYKLNG

SEQ ID NO: 20 - protein, 245 aa, Enterobacteria phage T4
  I-TevI P13299.2 (TEV1_BPT4)
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISEKMKGKKPSNIKKISCDGVIFDCAADAARHFKISSGLVTYRVKSDKWNWFYINA

SEQ ID NO: 21 - protein, 258 aa, Enterobacteria phage T4
  I-TevII P07072.2 (TEV2_BPT4)
MKWKLRKSLKIANSVAFTYMVRFPDKSFYIGFKKFKTIYGKDTNWKEYNSSSKLVKEKLKDYKAKWIILQVFDSYESALKHEEMLIRKYFNNEFILNKSIGGYKFNKYPDSEEHKQKLSNAHKGKILSLKHKDKIREKLIEHYKNNSRSEAHVKNNIGSRTAKKTVSIALKSGNKFRSFKSAAKFLKCSEEQVSNHPNVIDIKITIHPVPEYVKINDNIYKSFVDAAKDLKLHPSRIKDLCLDDNYPNYIVSYKRVEK

SEQ ID NO: 22 - protein, 269 aa, Bacteriophage RB3
  I-TevIII Q38419.1 (TEV3_BPR03)
MNYRKIWIDANGPIPKDSDGRTDEIHHKDGNRENNDLDNLMCLSIQEHYDIHLAQKDYQACHAIKLRMKYSPEEISELASKAAKSREIQIFNIPEVRAKNIASIKSKIENGTFHLLDGEIQRKSNLNRVALGIHNFQQAEHIAKVKERNIAAIKEGTHVFCGGKMQSETQSKRVNDGSHHFLSEDHKKRTSAKTLEMVKNGTHPAQKEITCDFCGHIGKGPGFYLKHNDRCKLNPNRIQLNCPYCDKKDLSPSTYKRWHGDNCKARFND

SEQ ID NO: 23 - protein, 243 aa, Staphylococcus phage Twort
  I-TwoI AAM00817.1
MEELWKEIPGFNSYMISNKGQVYSRKRNKILALRTDKNGYKRISIFNNEGKRILLGVHKLVLLGFKGINTEKPIPHHKNNIKDDNRLENLEWVTVSENTKHAYDIGALKSPRRVTCTLYYKGEPLSCYDSLFDLAKALKVSRSVIESPRNGLVLSTFEVKREPTIQGLPLNKEIFEHSLIKGLGNPPLKVYNEDETYYFLTLMDISKYFNESYSKVQRGYYKGKWKSYIIEHIDFYEYYKQTH

SEQ ID NO: 24 - protein, 262 aa, Moraxella sp.
  R.MspI P11405.1 (T2M1_MORSP)
MRTELLSKLYDDFGIDQLPHTQHGVTSDRLGKLYEKYILDIFKDIESLKKYNTNAFPQEKDISSKLLKALNLDLDNIIDVSSSDTDLGRTIAGGSPKTDATIRFTFHNQSSRLVPLNIKHSSKKKVSIAEYDVETICTGVGISDGELKELIRKHQNDQSAKLFTPVQKQRLTELLEPYRERFIRWCVTLRAEKSEGNILHPDLLIRFQVIDREYVDVTIKNIDDYVSDRIAEGSKARKPGFGTGLNWTYASGSKAKKMQFKG

SEQ ID NO: 25 - protein, 246 aa, Kocuria varians
  R.MvaI
MSEYLNLLKEAIQNVVDGGWHETKRKGNTGIGKTFEDLLEKEEDNLDAPDFHDIEIKTHETAAKSLLTLFTKSPTNPRGANTMLRNRYGKKDEYGNNILHQTVSGNRKTNSNSYNYDFKIDIDWESQVVRLEVFDKQDIMIDNSVYWSFDSLQNQLDKKLKYIAVISAESKIENEKKYYKYNSANLFTDLTVQSLCRGIENGDIKVDIRIGAYHSGKKKGKTHDHGTAFRINMEKLLEYGEVKVIV

SEQ ID NO: 26 - protein, 274 aa, Nostoc sp. PCC 7120
  NucA CAA45962.1
MGICGKLGVAALVALIVGCSPVQSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDN

SEQ ID NO: 27 - protein, 232 aa, Dickya dadantii
  NucM P37994.2 (NUCM_DICD3)
MLRNLVIFAVLGAGLTTLAAAGQDINNFTQAKAAAAKIHQDAPGTFYCGCKINWQGKKGTPDLASCGYQVRKDANRASRIEWEHVVPAWQFGHQRQCWQDGGRKNCTKDDVYRQIETDLHNLQPAIGEVNGDRGNFMYSQWNGGERQYGQCEMKIDFKSQLAEPPERARGAIARTYFYMRDRYNLNLSRQQTQLFDAWNKQYPATTWECTREKRIAAVQGNHNPYVQQACQP

SEQ ID NO: 28 - protein, 231 aa, Vibrio vulnificus
  Vvn AAF19759.1
MKRLFIFIASFTAFAIQAAPPSSFSAAKQQAVKIYQDHPISFYCGCDIEWQGKKGIPNLETCGYQVRKQQTRASRIEWEHVVPAWQFGHHRQCWQKGGRKNCSKNDQQFRLMEADLHNLTPAIGEVNGDRSNFNFSQWNGVDGVSYGRCEMQVNFKQRKVMPQTELRGSIARTYLYMSQEYGFQLSKQQQQLMQAWNKSYPVDEWECTRDDRIAKIQGNHNPFVQQSCQTQ

SEQ ID NO: 29 - protein, 222 aa, artificial sequence
  Vvn_CLS
MASGAPPSSFSAAKQQAVKIYQDHPISFYCGCDIEWQGKKGIPNLETCGYQVRKQQTRASRIEWEHVVPAWQFGHHRQCWQKGGRKNCSKNDQQFRLMEADLHNLTPAIGEVNGDRSNFNFSQWNGVDGVSYGRCEMQVNFKQRKVMPPDRARGSIARTYLYMSQEYGFQLSKQQQQLMQAWNKSYPVDEWECTRDDRIAKIQGNHNPFVQQSCQTQGSSAD

SEQ ID NO: 30 - protein, 231 aa, Staphylococcus hyicus
  Staphylococcal nuclease (NUC_STAAU) P00644.1
MLVMTEYLLSAGICMAIVSILLIGMAISNVSKGQYAKRFFFFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQHLRKSEAQAKKEKLNIWSEDNADSGQ

SEQ ID NO: 31 - protein, 169 aa, Staphylococcus hyicus
  Staphylococcal nuclease (NUC_STAHY) P43270.1
MKKITTGLIIVVAAIIVLSIQFMTESGPFKSAGLSNANEQTYKVIRVIDGDTIIVDKDGKQQNLRMIGVDTPETVKPNTPVQPYGKEASDFTKRHLTNQKVRLEYDKQEKDRYGRTLAYVWLGKEMFNEKLAKEGLARAKFYRPNYKYQERIEQAQKQAQKLKKNIWSN

SEQ ID NO: 32 - protein, 174 aa, Shigella flexneri
  Micrococcal nuclease (NUC_SHIFL) P29769.1
MKSALAALRAVAAAVVLIVSVPAWADFRGEVVRILDGDTIDVLVNRQTIRVRLADIDAPESGQAFGSRARQRLADLTFRQEVQVTEKEVDRYGRTLGVVYAPLQYPGGQTQLTNINAIMVQEGMAWAYRYYGKPTDAQMYEYEKEARRQRLGLWSDPNAQEPWKWRRASKNATN

SEQ ID NO: 33 - protein, 211 aa, BAcillus subtilis
  Endonuclease yncB P94492.1 (YNCB_BACSU)
MKKILISMIAIVLSITLAACGSNHAAKNHSDSNGTEQVSQDTHSNEYNQTEQKAGTPHSKNQKKLVNVTLDRAIDGDTIKVIYNGKKDTVRYLLVDTPETKKPNSCVQPYGEDASKRNKELVNSGKLQLEFDKGDRRDKYGRLLAYVYVDGKSVQETLLKEGLARVAYVYEPNTKYIDQFRLDEQEAKSDKLSIWSKSGYVTNRGFNGCVK

SEQ ID NO: 34 - protein, 149 aa, Enterobacteria phage T7
  Endodeoxyribonuclease I (ENRN_BPT7) P00641.1
MAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKK

SEQ ID NO: 35 - protein, 671 aa, Homo sapiens
  Metnase Q53H47.1
MAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 36 - protein, 488 aa, Geobacillus stearothermophilus
  Nb.BsrDI ABD15132.1
MTEYDLHLYADSFHEGHWCCENLAKIAQSDGGKHQIDYLQGFIPRHSLIFSDLIINITVFGSYKSWKHLPKQIKDLLFWGKPDFIAYDPKNDKILFAVEETGAVPTGNQALQRCERIYGSARKQIPFWYLLSEFGQHKDGGTRRDSIWPTIMGLKLTQLVKTPSIILHYSDINNPEDYNSGNGLKFLFKSLLQIIINYCTLKNPLKGMLELLSIQYENMLEFIKSQWKEQIDFLPGEEILNTKTKELARMYASLAIGQTVKIPEELFNWPRTDKVNFKSPQGLIKYDELCYQLEKAVGSKKAYCLSNNAGAKPQKLESLKEWINSQKKLFDKAPKLTPPAEFNMKLDAFPVTSNNNYYVTTSKNILYLFDYWKDLRIAIETAFPRLKGKLPTDIDEKPALIYICNSVKPGRLFGDPFTGQLSAFSTIFGKKNIDMPRIVVAYYPHQIYSQALPKNNKSNKGITLKKELTDFLIFHGGVVVKLNEGKAY

SEQ ID NO: 37 - protein, 217 aa, Geobacillus stearothermophilus
  BsrDI A ABD15133.1
MTDYRYSFELSEEIARWAFEIKTKNTDWFVAFSNPTAGPWKRVMAIDKASNREGEVHRFGREDERPDIILVNDNISLILILEAKEKLNQLISKSQVDKSVDVFLTLSSILKEKSDNNYWGDRTKYINVLGILWGSEQETSQKDIDNAFRVYRDSLVKNLKEINPTPTNICTDILVGVESIKNKKEEISIKIHVSNIYAEIYPKFTGKHLLEKLAVLN

SEQ ID NO: 38 - protein, 604 aa, Bacillus sp. D6
  Nt.BspD6I ABN42182.1 (R.BspD6I large subunit)
MAKKVNWYVSCSPRSPEKIQPELKVLANFEGSYWKGVKGYKAQEAFAKELAALPQFLGTTYKKEAAFSTRDRVAPMKTYGFVFVDEEGYLRITEAGKMLANNRRPKDVFLKQLVKWQYPSFQHKGKEYPEEEWSINPLVFVLSLLKKVGGLSKLDIAMFCLTATNNNQVDEIAEEIMQFRNEREKIKGQNKKLEFTENYFFKRFEKIYGNVGKIREGKSDSSHKSKIETKMRNARDVADATTRYFRYTGLFVARGNQLVLNPEKSDLIDEIISSSKVVKNYTRVEEFHEYYGNPSLPQFSFETKEQLLDLAHRIRDENTRLAEQLVEHFPNVKVEIQVLEDIYNSLNKKVDVETLKDVIYHAKELQLELKKKKLQADFNDPRQLEEVIDLLEVYHEKKNVIEEKIKARFIANKNTVFEWLTWNGFIILGNALEYKNNFVIDEELQPVTHAAGNQPDMEIIYEDFIVLGEVTTSKGATQFKMESEPVTRHYLNKKKELEKQGVEKELYCLFIAPEINKNTFEEFMKYNIVQNTRIIPLSLKQFNMLLMVQKKLIEKGRRLSSYDIKNLMVSLYRTTIECERKYTQIKAGLEETLNNWVVDKEVRF

SEQ ID NO: 39 - protein, 186 aa, Bacillus sp. D6
  ss.BspD6I (R.BspD6I small subunit)
MQDILDFYEEVEKTINPPNYFEWNTYRVFKKLGSYKNLVPNFKLDDSGHPIGNAIPGVEDILVEYEHFSILIECSLTIGEKQLDYEGDSVVRHLQEYKKKGIEAYTLFLGKSIDLSFARHIGFNKESEPVIPLTVDQFKKLVTQLKGDGEHFNPNKLKEILIKLLRSDLGYDQAEEWLTFIEYNLK

SEQ ID NO: 40 - protein, 555 aa, Paucimonas lemoignei
  R.PleI AAK27215.1
MAKPIDSKVLFITTSPRTPEKMVPEIELLDKNFNGDVWNKDTQTAFMKILKEESFFDGEGKNDPAFSARDRINRAPKSLGFVILTPKLSLTDAGVELIKAKRKDDIFLRQMLKFQLPSPYHKLSDKAALFYVKPYLEIFRLVRHFGSLTFDELMIFGLQIIDFRIFNQIVDKIEDFRVGKIENKGRYKTYKKERFEEELGKIYKDELFGLTEASAKTLITKKGNNMRDYADACVRYLRATGMVNVSYQGKSLSIVQEKKEEVDFFLKNTEREPCFINDEASYVSYLGNPNYPKLFVDDVDRIKKKLRFDFKKTNKVNALTLPELKEELENEILSRKENILKSQISDIKNFKLYEDIQEVFEKIENDRTLSDAPLMLEWNTWRAMTMLDGGEIKANLKFDDFGSPMSTAIGNMPDIVCEYDDFQLSVEVTMASGQKQYEMEGEPVSRHLGKLKKSSEKPVYCLFIAPKINPSSVAHFFMSHKVDIEYYGGKSLIIPLELSVFRKMIEDTFKASYIPKSDNVHKLFKNFASIADEAGNEKVWYEGVKRTAMNWLSLS

SEQ ID NO: 41 - protein, 556 aa, Micrococcus lylae
  MlyI AAK39546.1
MASLSKTKHLFGFTSPRTIEKIIPELDILSQQFSGKVWGENQINFFDAIFNSDFYEGTTYPQDPALAARDRITRAPKALGFIQLKPVIQLTKAGNQLVNQKRLPELFTKQLLKFQLPSPYHTQSPTVNFNVRPYLELLRLINELGSISKTEIALFFLQLVNYNKFDEIKNKILKFRETRKNNRSVSWKTYVSQEFEKQISIIFADEVTAKNFRTRESSDESFKKFVKTKEGNMKDYADAFFRYIRGTQLVTIDKNLHLKISSLKQDSVDFLLKNTDRNALNLSLMEYENYLFDPDQLIVLEDNSGLINSKIKQLDDSINVESLKIDDAKDLLNDLEIQRKAKTIEDTVNHLKLRSDIEDILDVFAKIKKRDVPDVPLFLEWNIWRAFAALNHTQAIEGNFIVDLDGMPLNTAPGKKPDIEINYGSFSCIVEVTMSSGETQFNMEGSSVPRHYGDLVRKVDHDAYCIFIAPKVAPGTKAHFFNLNRLSTKHYGGKTKIIPMSLDDFICFLQVGITHNFQDINKLKNWLDNLINFNLESEDEEIWFEEIISKISTWAI

SEQ ID NO: 42 - protein, 543 aa, Geobacillus sp. Y412MC52
  AlwI YP_004134094.1
MNKKNTRKVWFITRPERDPRFHQEALLALQKATDDFRLKWAGNREVHKRYEEELANMGIKRNNVSHDGSGGRTWMAMLKTFSYCYVDDDGYIRLTKVGEKLIQGEKVYENTRKQVLTLQYPNAYFLEPGFRPKFDEGFRIRPVLFLIKLANDERLDFYVTKEEITYFAMTAQKDSQLDEIVHKILAFRKAGPREREEMKQDIAAKFDHRERSDKGARDFYEAHSDVAHTFMLISDYTGLVEYIRGKALKGDSSKINEIKQEIAEIEKRYPFNTRYMISLERMAENSGLDVDSYKASRYGNIKPAANSSKLRAKAERILAQFPSIESMSKEEIAGALQKYLSPRDIEKVIHEIVENKDDFEGINSDFVETYLNEKDNLAFEDKTGQIFSALGFDVAMRPKAKNGERTEIEIIARYGGSKFGIIDAKNYAGKFPLSSSLVSHMASEYIPNYTGYEGKELTFFGYVTANDFSGERNLEKISDKAKRITGNPISGFLVTARTLLGFLDYCIENDVPLEDRAELFVKAVKNKGYKSLEALLRELKETI

SEQ ID NO: 43 - protein, 685 aa, Kocuria varians
  Mva1269I AAY97906.1
MYLNTAVFNIYGDNIVECSRAFHYILEGFKLANISITQEYDLQNITTPKFCIYTDKFRYIFIFIPGTSASRWNKDIYKELVLNNGGPLKEGADAIITRIFSEDSELVLASMEFSAALPAGNNTWQRSGRAYSLTAANIPYFYIVQLGGKEIKKGKDGKSDKFATRLPNPALSLSFTLNTIKKPAPSLIVYDQAPEADSAISDLYSNCYGIDDFSLYLFKLITEENNLHELKNIYNKNVEFLQLRSVDEKGKNFSGKDYKYIFEHKDPYKGLTEVVKERKIPWKKKTATKTFENFPLRNQAPIFRLIDFLSTKSYGIVSKDSLPLTFIPSEHRVEVANYICNQLYIDKVSDEFVKWIYKKEDLAICIINGFKPGGDDSRPDRGLPPFTKMLTNLDILTLMFGPAPPTQWDYLDSDPEKLNKTNGLWQSIFAFSDAILVDSSTRDNNKFVYNAYLKEHWVVQREKKESNTPISYFPKSVGEHDVDTSLHILFTYIGKHFESACNPPGGDWSGVSLLKNNIEYRWTSMYRVSQDGTKRPDHIYQLVYNSTDTLLLIESKGIKNDLLKSKEANVGIGMINYLKNLMARDYTAVKKDGEWKNIHGQMTLDKFLTFSAVAYLFTTDFDNEYTSAAELLVHSNTQLAFALEIKEKNSVMHIFTANTVAYNFAEYLLETMRNSHLPLKIYKPI

SEQ ID NO: 44 - protein, 599 aa, Geobacillus stearothermophilus
  BsrI ADR72996.1
MRNIRIYSEVKEQGIFFKEVIQSVLEKANVEVVLVNSAMLDYSDVSVISLIRNQKKFDLLVSEVRDKREIPIVMVEFSTAVTTDDHELQRADAMFWAYKYKIPYLKISPMEKKSQTADDKFGGGRLLSVNDQIIHMYRTDGVMYHIEWESMDNSAYVKNAELYPSCPDCAPELASLFRCLLETIEKCENIEDYYRILLDKLGKQKVAVKWGNFREEKTLEQWKHEKFDLLERFSKSSSRMEYDKDKKELKIKVNRYGHAMDPERGILAFWKLVLGDEWKIVAEFQLQRKTLKGRQSYQSLFDEVSQEEKLMNIASEIIKNGNVISPDKAIEIHKLATSSTMISTIDLGTPERKYITDDSLKGYLQHGLITNIYKNLLYYVDEIRFTDLQRKTIASLTWNKEIVNDYYKSLMDQLLDKNLRVLPLTSIKNISEDLITWSSKEILINLGYKILAASYPEAQGDRCILVGPTGKKTERKFIDLIAISPKSKGVILLECKDKLSKSKDDCEKMNDLLNHNYDKVTKLINVLNINNYNYNNIIYTGVAGLIGRKNVDNLPVDFVIKFKYDAKNLKLNWEINSDILGKHSGSFSMEDVAVVRKRS

SEQ ID NO: 45 - protein, 676 aa, Geobacillus stearothermophilus
  BsmI AAL86024.1
MNVFRIHGDNIIECERVIDLILSKINPQKVKRGFISLSCPFIEIIFKEGHDYFHWRFDMFPGFNKNTNDRWNSNILDLLSQKGSFLYETPDVIITSLNNGKEEILMAIEFCSALQAGNQAWQRSGRAYSVGRTGYPYIYIVDFVKYELNNSDRSRKNLRFPNPAIPYSYISHSKNTGNFIVQAYFRGEEYQPKYDKKLKFFDETIFAEDDIADYIIAKLQHRDTSNIEQLLINKNLKMVEFLSKNTKNDNNFTYSEWESIYNGTYRITNLPSLGRFKFRKKIAEKSLSGKVKEFNNIVQRYSVGLASSDLPFGVIRKESRNDFINDVCKLYNINDMKIIKELKEDADLIVCMLKGFKPRGDDNRPDRGALPLVAMLAGENAQIFTFIYGPLIKGAINLIDQDINKLAKRNGLWKSFVSLSDFIVLDCPIIGESYNEFRLIINKNNKESILRKTSKQQNILVDPTPNHYQENDVDTVIYSIFKYIVPNCFSGMCNPPGGDWSGLSIIRNGHEFRWLSLPRVSENGKRPDHVIQILDLFEKPLLLSIESKEKPNDLEPKIGVQLIKYIEYLFDFTPSVQRKIAGGNWEFGNKSLVPNDFILLSAGAFIDYDNLTENDYEKIFEVTGCDLLIAIKNQNNPQKWVIKFKPKNTIAEKLVNYIKLNFKSNIFDTGFFHIEG

SEQ ID NO: 46 - protein, 465 aa, artificial sequence
  Nb.BtsCI ADI24225.1
MKRILYLLTEERPKINIIHQIINLEYKATLHFGAKIVPVMNEENKFTFIYHVKGIEVEGFDAVLIKIVSGHSSFVDYLVFDSNDLKPEKNTITLFDLDQYELDLSYYFGKGWIVRIPSPSDLPKYVVEETKTDDHESRNTNAYQRSSKFVFCELYYGKEVKKYMLYDISDGRTLSGTDTHNFGMRMLVTNNVNLVGVPNMYLPFTDIKEFINEKNRIADNGPSHNVPIRLKLDKEKNVIYISAKLDKGNGKNKNKISNDPNIGAVAIISATLRNLNWKGDIEIINHNLLPSSISSRSNGNKLLYIMKKLGVRFNNINVNWNNIKNNINYFFYNITSEKIVSIYYHLYVEDKLSNARVIFDNHAGCGKSYFRTLNNKIIPVGKEIPLPALVIFDSDQNIVKVIAAAKAENVYNGVEQLSTFDKFIESYINKYYPGAAVECSVITWGKSSNPYVSFYLDKDGSAVFL

SEQ ID NO: 47 - protein, 465 aa, artificial sequence
  Nt.BtsCI ADI24224.1
MKRILYLLTEERPKINIIHQIINLEYKATLHFGAKIVPVMNEENKFTFIYHVKGIEVEGFDAVLIKIVSGHSSFVDYLVFDSNDLKPEKNTITLFDLDQYELDLSYYFGKGWIVRIPSPSDLPKYVVFETKTDDHESRNTNAYQRSSKFVFCELYYGKEVKKYMLYDISDGRTLSGTDTHNFGMRMLVTNNVNLVGVPNMYLPFTDIKEFINEKNRIADNGPSHNVPIRLKLDKEKNVIYISAKLDKGNGKNKNKISNDPNIGAVAIISATLRNLNWKGDIEIINHNLLPSSISSRSNGNKLLYIMKKLGVRFNNINVNWNNIKNNINYFFYNITSEKIVSIYYHLYVEDKLSNARVIFDNHAGCGKSYFRTLNNKIIPVGKEIPLPDLVIFDSDQNIVKVIEAEKAENVYNGVEQLSTFDKFIESYINKYYPGAAVECSVITWGKSSNPYVSFYLDKDGSAVFL

SEQ ID NO: 48 - protein, 164 aa, Geobacillus thermoglucosidasius
  R1.BtsI ABC75874.1
MKITEGIVHVAMRHFLKSNGWKLIAGQYPGGSDDELTALNIVDPVVARDNSPDPRRHSLGKIVPDLIAYKNDDLLVIEAKPKYSQDDRDKLLYLLSERKHDFYAALEKFATERNHPELLPVSKLNIIPGLAFSASENKFKKDPGFVYIRVSGIFEAFMEGYDWG

SEQ ID NO: 49 - protein, 328 aa, Geobacillus thermoglucosidasius
  R2.BtsI ABC75876.1
MQIEQLMKSLTIYFDDIQEGLWFKNLHPLLESASLEAITGSLKRNPNLADVLKYDRPDIILTLNQTPILVIERTIEVPSGHNVGQRYGRLAAASEAGVPLVYFGPYAARKHGGATEGPRYMNLRLFYALDVMQKVNGSAITTINWPVDQNFEILQDPSKDKRMKEYLEMFFDNLLKYGIAGINLAIRNSSFQAEQLAEREKFVETMITNPEQYDVPPDSVQILNAERFFNELGISENKRIICDEVVLYQVGMTYVRSDPYTGMALLYKYLYILGSERNRCLILKFPNITTDMWKKVAFGSRERKDVRIYRSVSDGILFADGYLSKEEL

SEQ ID NO: 50 - protein, 275 aa, Brevibacillus brevis
  BbvCI subunit 1 AAX14652.1
MINEDFFIYEQLSHKKNLEQKGKNAFDEETEELVRQAKSGYHAFIEGINYDEVTKLDLNSSVAALEDYISIAKEIEKKHKMFNWRSDYAGSIIPEFLYRIVHVATVKAGLKPIFSTRNTIIEISGAAHREGLQIRRKNEDFALGFHEVDVKIASESHRVISLAVACEVKTNIDKNKLNGLDFSAERMKRTYPGSAYFLITETLDFSPDENHSSGLIDEIYVLRKQVRTKNRVQKAPLCPSVFAELLEDILEISYRASNVKGHVYDRLEGGKLIRV

SEQ ID NO: 51 - protein, 285 aa, Brevibacillus brevis
  BbvCI subunit 2 AAX14653.1
MFNQFNPLVYTHGGKLERKSKKDKTASKVFEEFGVMEAYNCWKEASLCIQQRDKDSVLKLVAALNTYKDAVEPIFDSRLNSAQEVLQPSILEEFFEYLFSRIDSIVGVNIPIRHPAKGYLSLSFNPHNIETLIQSPEYTVRAKDHDFIIGGSAKLTIQGHGGEGETTNIVVPAVAIECKRYLERNMLDECAGTAERLKRATPYCLYFVVAEYLKLDDGAPELTEIDEIYILRHQRNSERNKPGFKPNPIDGELIWDLYQEVMNHLGKIWWDPNSALQRGKVFNRP

SEQ ID NO: 52 - protein, 294 aa, Bacillus pumilus
  Bpu10I alpha subunit CAA74998.1
MGVEQEWIKNITDMYQSPELIPSHASNLLHQLKREKRNEKLKKALEIITPNYISYISILLNNHNMTRKEIVILVDALNEYMNTLRHPSVKSVFSHQADFYSSVLPEFFNLLFRNLIKGLNEKIKVNSQKDIIIDCIFDPYNEGRVVFKKKRVDVAIILKNKFVFNNVEISDFAIPLVAIEIKTNLDKNMLSGIEQSVDSLKETFPLCLYYCITELADFAIEKQNYASTHIDEVFILRKQKRGPVRRGTPLEVVHADLILEVVEQVGEHLSKFKDPIKTLKARMTEGYLIKGKGK

SEQ ID NO: 53 - protein, 288 aa, Bacillus pumilus
  Bpu10I beta subunit CAA74999.1
MTQIDLSNTKHGSILFEKQKNVKEKYLQQAYKHYLYFRRSIDGLEITNDEAIFKLTQAANNYRDNVLYLFESRPNSGQEAFRYTILEEFFYHLFKDLVKKKFNQEPSSIVMGKANSYVSLSFSPESFLGLYENPIPYIHTKDQDFVLGCAVDLKISPKNELNKENETEIVVPVIAIECKTYIERNMLDSCAATASRLKAAMPYCLYIVASEYMKMDQAYPELTDIDEVFILCKASVGERTALKKKGLPPHKLDENLMVELFHMVERHLNRVWWSPNEALSRGRVIGRP

SEQ ID NO: 54 - protein, 358 aa, Bacillus megaterium
  BmrI ABM69266.1
MNYFSLHPNVYATGRPKGLINMLESVWISNQKPGDGTMYLISGFANYNGGIRFYETFTEHINHGGKVIAILGGSTSQRLSSKQVVAELVSRGVDVYIINRKRLLHAKLYGSSSNSGESLVVSSGNFTGPGMSQNVEASLLLDNNTTSSMGFSWNGMVNSMLDQKWQIHNLSNSNPTSPSWNLLYDERTTNLTLDDTQKVTLILTLGHADTARIQAAPKSKAGEGSQYFWLSKDSYDFFPPLTIRNKRGTKATYSCLINMNYLDIKYIDSECRVTFEAENNFDFRLGTGKLRYTNVAASDDIAAITRVGDSDYELRIIKKGSSNYDALDSAAVNFIGNRGKRYGYIPNDEFGRIIGAKF

SEQ ID NO: 55 - protein, 358 aa, Bacillus firmus
  BfiI CAC12783.1
MNFFSLHPNVYATGRPKGLIGMLENVWVSNHTPGEGTLYLISGFSNYNGGVRFYETFTEHINQGGRVIAILGGSTSQRLSSRQVVEELLNRGVEVHIINRKRILHAKLYGTSNNLGESLVVSSGNFTGPGMSQNIEASLLLDNNTTQSMGFSWNDMISEMLNQNWHIHNMTNATDASPGWNLLYDERTTNLTLDETERVTLIVTLGHADTARIQAAPGTTAGQGTQYFWLSKDSYDFFPPLTIRNRRGTKATYSSLINMNYIDINYTDTQCRVTFEAENNFDFRLGTGKLRYTGVAKSNDIAAITRVGDSDYELRIIKQGTPEHSQLDPYAVSFIGNRGKRFGYISNEEFGRIIGVTF

SEQ ID NO: 56 - protein, 846 aa, Homo sapiens
  hExoI (EXO1_HUMAN)  Q9UQ84.2
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 57 - protein, 702 aa, Saccharomyces cerevisiae
  Yeast ExoI (EXO1_YEAST) P39875.2
MGIQGLLPQLKPIQNPVSLRRYEGEVLAIDGYAWLHRAACSCAYELAMGKPTDKYLQFFIKRFSLLKTFKVEPYLVFDGDAIPVKKSTESKRRDKRKENKAIAERLWACGEKKNAMDYFQKCVDITPEMAKCIICYCKLNGIRYIVAPFEADSQMVYLEQKNIVQGIISEDSDLLVFGCRRLITKLNDYGECLEICRDNFIKLPKKFPLGSLTNEEIITMVCLSGCDYTNGIPKVGLITAMKLVRRFNTIERIILSIQREGKLMIPDTYINEYEAAVLAFQFQRVFCPIRKKIVSLNEIPLYLKDTESKRKRLYACIGFVIHRETQKKQIVHFDDDIDHHLHLKIAQGDLNPYDFHQPLANREHKLQLASKSNIEFGKTNTTNSEAKVKPIESFFQKMTKLDHNPKVANNIHSLRQAEDKLTMAIKRRKLSNANVVQETLKDTRSKFFNKPSMTVVENFKEKGDSIQDFKEDTNSQSLEEPVSESQLSTQIPSSFITTNLEDDDNLSEEVSEVVSDIEEDRKNSEGKTIGNEIYNTDDDGDGDTSEDYSETAESRVPTSSTTSFPGSSQRSISGCTKVLQKFRYSSSFSGVNANRQPLFPRHVNQKSRGMVYVNQNRDDDCDDNDGKNQITQRPSLRKSLIGARSQRIVIDMKSVDERKSFNSSPILHEESKKRDIETTKSSQARPAVRSISLLSQFVYKGK

SEQ ID NO: 58 - protein, 475 aa, Escherichia coli DH1
  E.coli ExoI BAJ43803.1
MMNDGKQQSTFLFHDYETFGTHPALDRPAQFAAIRTDSEFNVIGEPEVFYCKPADDYLPQPGAVLITGITPQEARAKGENEAAFAARIHSLFTVPKTCILGYNNVRFDDEVTRNIFYRNFYDPYAWSWQHDNSRWDLLDVMRACYALRPEGINWPENDDGLPSFRLEHLTKANGIEHSNAHDAMADVYATIAMAKLVKTRQPRLFDYLFTHRNKHKLMALIDVPQMKPLVHVSGMFGAWRGNTSWVAPLAWHPENRNAVIMVDLAGDISPLLELDSDTLRERLYTAKTDLGDNAAVPVKLVHINKCPVLAQANTLRPEDADRLGINRQHCLDNLKILRENPQVREKVVAIFAEAEPFTPSDNVDAQLYNGFFSDADRAAMKIVLETEPRNLPALDITFVDKRIEKLLFNYRARNFPGTLDYAEQQRWLEHRRQVFTPEFLQGYADELQMLVQQYADDKEKVALLKALWQYAEEIV

SEQ ID NO: 59 - protein, 279 aa, Homo sapiens
  TREX2_HUMAN Q9BQ50.1
MGRAGSPLPRSSWPRMDDCGSRSRCSPTLCSSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 60 - protein, 314 aa, Mus musculus
  TREX1_MOUSE Q91XB0.2
MGSQTLPHGHMQTLIFLDLEATGLPSSRPEVTELCLLAVHRRALENTSISQGHPPPVPRPPRVVDKLSLCIAPGKACSPGASEITGLSKAELEVQGRQRFDDNLAILLRAFLQRQPQPCCLVAHNGDRYDFPLLQTELARLSTPSPLDGTFCVDSIAALKALEQASSPSGNGSRKSYSLGSIYTRLYWQAPTDSHTAEGDVLTLLSICQWKPQALLQWVDEHARPFSTVKPMYGTPATTGTTNLRPHAATATTPLATANGSPSNGRSRRPKSPPPEKVPEAPSQEGLLAPLSLLTLLTLAIATLYGLFLASPGQ

SEQ ID NO: 61 - protein, 369 aa, Homo sapiens
  TREX1_HUMAN  Q9NSU2.1
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 62 - protein, 315 aa, Bos taurus
  TREX1_BOVIN  Q9BG99.1
MGSRALPPGPVQTLIFLDLEATGLPFSQPKITELCLLAVHRYALEGLSAPQGPSPTAPVPPRVLDKLSLCVAPGKVCSPAASEITGLSTAVLAAHGRRAFDADLVNLIRTFLQRQPQPWCLVAHNGDRYDFPLLRAELALLGLASALDDAFCVDSIAALKALEPTGSSSEHGPRKSYSLGSVYTRLYGQAPPDSHTAEGDVLALLSVCQWRPRALLRWVDAHAKPFSTVKPMYVITTSTGTNPRPSAVTATVPLARASDTGPNLRGDRSPKPAPSPKMCPGAPPGEGLLAPLGLLAFLTLAVAMLYGLSLAMPGQ

SEQ ID NO: 63 - protein, 316 aa, Rattus norvegicus
  Rat TREX1 AAH91242.1
MGSQALPHGHMQTLIFLDLEATGLPYSQPKITELCLLAVHRHALENSSMSEGQPPPVPKPPRVVDKLSLCIAPGKPCSSGASEITGLTTAGLEAHGRQRFNDNLATLLQVFLQRQPQPCCLVAHNGDRYDFPLLQAELASLSVISPLDGTFCVDSIAALKTLEQASSPSEHGPRKSYSLGSIYTRLYGQAPTDSHTAEGDVLALLSICQWKPQALLQWVDKHARPFSTIKPMYGMAATTGTASPRLCAATTSSPLATANLSPSNGRSRGKRPTSPPPENVPEAPSREGLLAPLGLLTFLTLAIAVLYGIFLASPGQ

SEQ ID NO: 64 - protein, 829 aa, Homo sapiens
  Human DNA2 AAH63664.1
FAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 65 - protein, 1522 aa, Saccharomyces cerevisiae
  DNA2YEAST  P38859.1
MPGTPQKNKRSASISVSPAKKTEEKEIIQNDSKAILSKQTKRKKKYAFAPINNLNGKNTKVSNASVLKSIAVSQVRNTSRTKDINKAVSKSVKQLPNSQVKPKREMSNLSRHHDFTQDEDGPMEEVIWKYSPLQRDMSDKTTSAAEYSDDYEDVQNPSSTPIVPNRLKTVLSFTNIQVPNADVNQLIQENGNEQVRPKPAEISTRESLRNIDDILDDIEGDLTIKPTITKFSDLPSSPIKAPNVEKKAEVNAEEVDKMDSTGDSNDGDDSLIDILTQKYVEKRKSESQITIQGNTNQKSGAQESCGKNDNTKSRGEIEDHENVDNQAKTGNAFYENEEDSNCQRIKKNEKIEYNSSDEFSDDSLIELLNETQTQVEPNTIEQDLDKVEKMVSDDLRIATDSTLSAYALRAKSGAPRDGVVRLVIVSLRSVELPKIGTQKILECIDGKGEQSSVVVRHPWVYLEFEVGDVIHIIEGKNIENKRLLSDDKNPKTQLANDNLLVLNPDVLFSATSVGSSVGCLRRSILQMQFQDPRGEPSLVMTLGNIVHELLQDSIKYKLSHNKISMEIIIQKLDSLLETYSFSIIICNEEIQYVKELVMKEHAENILYFVNKFVSKSNYGCYTSISGTRRTQPISISNVIDIEENIWSPIYGLKGFLDATVEANVENNKKHIVPLEVKTGKSRSVSYEVQGLIYTLLLNDRYEIPIEFFLLYFTRDKNMTKFPSVLHSIKHILMSRNRMSMNFKHQLQEVFGQAQSRFELPPLLRDSSCDSCFIKESCMVLNKLLEDGTPEESGLVEGEFEILTNHLSQNLANYKEFFTKYNDLITKEESSITCVNKELFLLDGSTRESRSGRCLSGLVVSEVVEHEKTEGAYIYCFSRRRNDNNSQSMLSSQIAANDFVIISDEEGHFCLCQGRVQFINPAKIGISVKRKLLNNRLLDKEKGVTTIQSVVESELEQSSLIATQNLVTYRIDKNDIQQSLSLARFNLLSLFLPAVSPGVDIVDERSKLCRKTKRSDGGNEILRSLLVDNRAPKFRDANDDPVIPYKLSKDTTLNLNQKEAIDKVMRAEDYALILGMPGTGKTTVIAEIIKILVSEGKRVLLTSYTHSAVDNILIKLRNTNISIMRLGMKHKVHPDTQKYVPNYASVKSYNDYLSKINSTSVVATTCLGINDILFTLNEKDFDYVILDEASQISMPVALGPLRYGNRFIMVGDHYQLPPLVKNDAARLGGLEESLFKTFCEKHPESVAELTLQYRMCGDIVTLSNFLIYDNKLKCGNNEVFAQSLELPMPEALSRYRNESANSKQWLEDILEPTRKVVFLNYDNCPDIIEQSEKDNITNHGEAELTLQCVEGMLLSGVPCEDIGVMTLYRAQLRLLKKIFNKNVYDGLEILTADQFQGRDKKCIIISMVRRNSQLNGGALLKELRRVNVAMTRAKSKLIIIGSKSTIGSVPEIKSFVNLLEERNWVYTMCKDALYKYKFPDRSNAIDEARKGCGKRTGAKPITSKSKFVSDKPIIKEILQEYES

SEQ ID NO: 66 - protein, 490 aa, Human herpesvirus 2
  VP16 AAA45863.1
MDLLVDDLFADRDGVSPPPPRPAGGPKNTPAAPPLYATGRLSQAQLMPSPPMPVPPAALFNRLLDDLGFSAGPALCTMLDTWNEDLFSGFPTNADMYRECKFLSTLPSDVIDWGDAHVPERSPIDIRAHGDVAFPTLPATRDELPSYYEAMAQFFRGELRAREESYRTVLANFCSALYRYLRASVRQLHRQAHMRGRNRDLREMLRTTIADRYYRETARLARVLFLHLYLFLSREILWAAYAEQMMRPDLFDGLCCDLESWRQLACLFQPLMFINGSLTVRGVPVEARRLRELNHIREHLNLPLVRSAAAEEPGAPLTTPPVLQGNQARSSGYFMLLIRAKLDSYSSVATSEGESVMREHAYSRGRTRNNYGSTIEGLLDLPDDDDAPAEAGLVAPRMSFLSAGQRPRRLSTTAPITDVSLGDELRLDGEEVDMTPADALDDFDLEMLGDVESPSPGMTHDPVSYGALDVDDFEFEQMFTDAMGIDDFGG

SEQ ID NO: 67 - protein, 3 aa, Artificial
  1a8h_1 peptidic linker
NVG

SEQ ID NO: 68 - protein, 4 aa, Artificial
  1dnpA_1 peptidic linker
DSVI

SEQ ID NO: 69 - protein, 4 aa, Artificial
  1d8cA_2 peptidic linker
IVEA

SEQ ID NO: 70 - protein, 4 aa, Artificial
  1ckqA_3 peptidic linker
LEGS

SEQ ID NO: 71 - protein, 4 aa, Artificial
  1sbp_1 peptidic linker
YTST

SEQ ID NO: 72 - protein, 5 aa, Artificial
  1ev7A_1 peptidic linker
LQENL

SEQ ID NO: 73 - protein, 5 aa, Artificial
  1alo_3 peptidic linker
VGRQP

SEQ ID NO: 74 - protein, 5 aa, Artificial
  1amf_1 peptidic linker
LGNSL

SEQ ID NO: 75 - protein, 6 aa, Artificial
  1adjA_3 peptidic linker
LPEEKG

SEQ ID NO: 76 - protein, 6 aa, Artificial
  1fcdC_1 peptidic linker
QTYQPA

SEQ ID NO: 77 - protein, 6 aa, Artificial
  1al3_2 peptidic linker
FSHSTT

SEQ ID NO: 78 - protein, 7 aa, Artificial
  1g3p_1 peptidic linker
GYTYINP

SEQ ID NO: 79 - protein, 7 aa, Artificial
  1acc_3 peptidic linker
LTKYKSS

SEQ ID NO: 80 - protein, 8 aa, Artificial
  1ahjB_1 peptidic linker
SRPSESEG

SEQ ID NO: 81 - protein, 8 aa, Artificial
  1acc_1 peptidic linker
PELKQKSS

SEQ ID NO: 82 - protein, 8 aa, Artificial
  1af7_1 peptidic linker
LTTNLTAF

SEQ ID NO: 83 - protein, 9 aa, Artificial
  1heiA_1 peptidic linker
TATPPGSVT

SEQ ID NO: 84 - protein, 9 aa, Artificial
  1bia_2 peptidic linker
LDNFINRPV

SEQ ID NO: 85 - protein, 9 aa, Artificial
  1igtB_1 peptidic linker
VSSAKTTAP

SEQ ID NO: 86 - protein, 10 aa, Artificial
  1nfkA_1 peptidic linker
DSKAPNASNL

SEQ ID NO: 87 - protein, 10 aa, Artificial
  1au7A_1 peptidic linker
KRRTTISIAA

SEQ ID NO: 88 - protein, 11 aa, Artificial
  1bpoB_1 peptidic linker
PVKMFDRHSSL

SEQ ID NO: 89 - protein, 11 aa, Artificial
  1b0pA_2 peptidic linker
APAETKAEPMT

SEQ ID NO: 90 - protein, 14 aa, Artificial
  1c05A_2 peptidic linker
YTRLPERSELPAEI

SEQ ID NO: 91 - protein, 14 aa, Artificial
  1gcb_1 peptidic linker
VSTDSTPVTNQKSS

SEQ ID NO: 92 - protein, 14 aa, Artificial
  1bt3A_1 peptidic linker
YKLPAVTTMKVRPA

SEQ ID NO: 93 - protein, 15 aa, Artificial
  1b3oB_2 peptidic linker
IARTDLKKNRDYPLA

SEQ ID NO: 94 - protein, 21 aa, Artificial
  16vpA_6 peptidic linker
TEEPGAPLTTPPTLHGNQARA

SEQ ID NO: 95 - protein, 21 aa, Artificial
  1dhx_1 peptidic linker
ARFTLAVGDNRVLDMASTYFD

SEQ ID NO: 96 - protein, 26 aa, Artificial
  1b8aA_1 peptidic linker
IVVLNRAETPLPLDPTGKVKAELDTR

SEQ ID NO: 97 - protein, 28 aa, Artificial
  1qu6A_1 peptidic linker
ILNKEKKAVSPLLLTTTNSSEGLSMGNY

SEQ ID NO: 98 - protein, 20 aa, Artificial
  NFS1 peptidic linker
GSDITKSKISEKMKGQGPSG

SEQ ID NO: 99 - protein, 23 aa, Artificial
  NFS2 peptidic linker
GSDITKSKISEKMKGLGPDGRKA

SEQ ID NO: 100 - protein, 10 aa, Artificial
  CFS1 peptidic linker
SLTKSKISGS

SEQ ID NO: 101 - protein, 32 aa, Artificial
  RM2 peptidic linker
AAGGSALTAGALSLTAGALSLTAGALSGGGGS

SEQ ID NO: 102 - protein, 27 aa, Artificial
  BQY peptidic linker
AAGASSVSASGHIAPLSLPSSPPSVGS

SEQ ID NO: 103 - protein, 5 aa, Artificial
  QGPSG peptidic linker
QGPSG

SEQ ID NO: 104 - protein, 8 aa, Artificial
  LGPDGRKA peptidic linker
LGPDGRKA

SEQ ID NO: 105 - DNA, 43 bp, Artificial
  I-TevI target
caacgctcagtagatgttttcttgggtctaccgtttaatattg

SEQ ID NO: 106 - protein, 167 aa, artificial sequence
  I-CreI
MANTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 107 - protein, 245 aa, artificial sequence; identical to SEQ ID NO: 20
  I-TevI

SEQ ID NO: 108 - protein, 167 aa, artificial sequence
  I-CreI_N20
MANTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 109 - protein, 366 aa, artificial sequence
  hTevCre_D01
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSGNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 110 - protein, 353 aa, artificial sequence
  hTevCre_D02
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 111 - protein, 339 aa, artificial sequence
  hTevCre_D03
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNQGPSGNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 112 - protein, 318 aa, artificial sequence
  hTevCre_D04
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHQGPSGNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 113 - protein, 293 aa, artificial sequence
  hTevCre_D05
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKQGPSGNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 114 - protein, 296 aa, artificial sequence
  hTevCre_D06
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKANTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 115 - protein, 366 aa, artificial sequence
  hTevCre_D01_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 116 - protein, 353 aa, artificial sequence
  hTevCre_D02_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 117 - protein, 339 aa, artificial sequence
  hTevCre_D03_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 118 - protein, 318 aa, artificial sequence
  hTevCre_D04_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 119 - protein, 293 aa, artificial sequence
  hTevCre_D05_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKQGPSGNTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 120 - protein, 296 aa, artificial sequence
  hTevCre_D06_N20
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKANTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSPAAD

SEQ ID NO: 121 - protein, 157 aa, artificial sequence
  I-CreI_X
MANTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSAD

SEQ ID NO: 122 - protein, 177 aa, artificial sequence
  I-CreI_NFS1
MAGSDITKSKISEKMKGQGPSGNTKYNKEFLLYLAGFVDGDGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 123 - protein, 180 aa, artificial sequence
  I-CreI_NFS2
MAGSDITKSKISEKMKGLGPDGRKANTKYNKEFLLYLAGFVDGDGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 124 - protein, 166 aa, artificial sequence
  I-CreI_CFS1
MANTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLTKSKISGSAD

SEQ ID NO: 125 - protein, 177 aa, artificial sequence
  I-CreI_NFS1_N20
MAGSDITKSKISEKMKGQGPSGNTKYNKEFLLYLAGFVDGNGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 126 - protein, 180 aa, artificial sequence
  I-CreI_NFS2_N20
MAGSDITKSKISEKMKGLGPDGRKANTKYNKEFLLYLAGFVDGNGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 127 - protein, 166 aa, artificial sequence
  I-CreI_CFS1_N20
MANTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLTKSKISGSAD

SEQ ID NO: 128 - protein, 311 aa, artificial sequence
  hColE7Cre_D0101
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSDITKSKISEKMKGQGPSGNTKYNKEFLLYLAGFVDGDGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 129 - protein, 314 aa, artificial sequence
  hColE7Cre_D0102
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSDITKSKISEKMKGLGPDGRKANTKYNKEFLLYLAGFVDGDGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 130 - protein, 300 aa, artificial sequence
  hCreColE7_D0101
MANTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLTKSKISGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 131 - protein, 311 aa, artificial sequence
  hColE7Cre_D0101_N20
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSDITKSKISEKMKGQGPSGNTKYNKEFLLYLAGFVDGNGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 132 - protein, 314 aa, artificial sequence
  hColE7Cre_D0102_N20
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSDITKSKISEKMKGLGPDGRKANTKYNKEFLLYLAGFVDGNGSIIAQIKPNQSYKFKHQLSLTFQVTQKTQRRWFLDKLVDEIGVGYVRDRGSVSDYILSEIAPLHNFLTQLQPFLKLKQKQANLVLKIIEQLPSAKESPDKFLEVCTWVDQIAALNDSKTRKTTSETVRAVLDSAD

SEQ ID NO: 133 - protein, 300 aa, artificial sequence
  hCreColE7_D0101_N20
MANTKYNKEFLLYLAGFVDGNGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLTKSKISGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 134 - protein, 518 aa, artificial sequence
  sT1
DPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNSIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDP

SEQ ID NO: 135 - protein, 147 aa, artificial sequence
  sT2
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNSIVAQLSRPDP

SEQ ID NO: 136 - protein, 1116 aa, artificial sequence
  bT1-Avr
DPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDP

SEQ ID NO: 137 - protein, 745 aa, artificial sequence
  bT2-Avr
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDP

SEQ ID NO: 138 - protein, 1320 aa, artificial sequence
  bT1-Pth
DPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNKGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASNKGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASHDGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDP

SEQ ID NO: 139 - protein, 949 aa, artificial sequence
  bT2-Pth
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNKGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASNKGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASHDGGRPALESIVAQLSRPDP

SEQ ID NO: 140 - protein, 141 aa, artificial sequence
  ColE7
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 141 - DNA, 2217 bp, Artificial sequence
  pCLS7183 Scaffold
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagccagtcagcgttgggaccgtatcctccaggcatcagggatgaaaagggccaaaccgtcccctacttcaactcaaacgccggatcaggcgtctttgcatgcattcgccgattcgctggagcgtgaccttgatgcgcctagcccaatgcacgagggagatcagacgcgggcaagtagccgtaaacggtcccgatcggatcgtgctgtcaccggtccctccgcacagcaatcgttcgaggtgcgcgttcccgaacagcgcgatgcgctccatttgcccctctcctggagggtaaaacgcccgcgtaccagtatcgggggcggcctcccggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 142 - DNA, 35 bp, Artificial sequence
  Primer CMP_G061
cggcggccatggtggatctacgcacgctcggctac

SEQ ID NO: 143 - DNA, 36 bp, Artificial sequence
  Primer CMP_G065
cgcggcggatcccggatcagggcgagataactgggc

SEQ ID NO: 144 - DNA, 3032 bp, Artificial sequence
  pCLS7865
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggcaaacaccggtggatcctccggaagatcttcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 145 - DNA, 3503 bp, Artificial sequence
  pCLS9009 (pCLS7865-cTAL11_CFS1)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatcctccggaagatcttcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 146 - DNA, 9402 bp, Artificial sequence
  pCLS6614
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 147 - DNA, 36 bp, Artificial sequence
  Primer CMP_G069
gccaccggatccaagtctggcatctaccagattaag

SEQ ID NO: 148 - DNA, 35 bp, Artificial sequence
  Primer CMP_G070
tggtatcggccgatggaccttgacctttcatcttg

SEQ ID NO: 149 - DNA, 35 bp, Artificial sequence
  Primer CMP_G071
tggtatcggccgatggaccttgagaatgcttgtgg

SEQ ID NO: 150 - DNA, 4085 bp, Artificial sequence
  pCLS9010 (pCLS 7865-cT11 TevD01)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 151 - DNA, 4046 bp, Artificial sequence
  pCLS9011 (pCLS 7865-cT11 TevD02)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 152 - protein, 598 aa, Artificial sequence
  RVDs AvrBs3
LTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALE

SEQ ID NO: 153 - DNA, 5798 bp, Artificial sequence
  pCLS9013
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 154 - DNA, 11148 bp, Artificial sequence
  pCLS8523
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 155 - DNA, 11109 bp, Artificial sequence
  pCLS8524
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 156 - DNA, 8334 bp, Artificial sequence
  pCLS0542
tgtgtgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccggcgcgcccacta

SEQ ID NO: 157 - DNA, 43 bp, Artificial sequence
  Avr05
tatataaacctaaccctctaggtaagagggttaggtttatata

SEQ ID NO: 158 - DNA, 44 bp, Artificial sequence
  Avr06
tatataaacctaaccctctaaggtaagagggttaggtttatata

SEQ ID NO: 159 - DNA, 45 bp, Artificial sequence
  Avr07
tatataaacctaaccctctaaggtacagagggttaggtttatata

SEQ ID NO: 160 - DNA, 46 bp, Artificial sequence
  Avr08
tatataaacctaaccctctgaaggtacagagggttaggtttatata

SEQ ID NO: 161 - DNA, 47 bp, Artificial sequence
  Avr09
tatataaacctaaccctctgaaggtaccagagggttaggtttatata

SEQ ID NO: 162 - DNA, 48 bp, Artificial sequence
  Avr10
tatataaacctaaccctcttgaaggtaccagagggttaggtttatata

SEQ ID NO: 163 - DNA, 49 bp, Artificial sequence
  Avr11
tatataaacctaaccctcttgaaggtacctagagggttaggtttatata

SEQ ID NO: 164 - DNA, 50 bp, Artificial sequence
  Avr12
tatataaacctaaccctctatgaaggtacctagagggttaggtttatata

SEQ ID NO: 165 - DNA, 51 bp, Artificial sequence
  Avr13
tatataaacctaaccctctatgaaggtaccttagagggttaggtttatata

SEQ ID NO: 166 - DNA, 52 bp, Artificial sequence
  Avr14
tatataaacctaaccctctcatgaaggtaccttagagggttaggtttatata

SEQ ID NO: 167 - DNA, 53 bp, Artificial sequence
  AVR15
tatataaacctaaccctcttagcatgaaggtaccagagggttaggtttatata

SEQ ID NO: 168 - DNA, 54 bp, Artificial sequence
  Avr16
tatataaacctaaccctctgcatgaaggtaccttgagagggttaggtttatata

SEQ ID NO: 169 - DNA, 55 bp, Artificial sequence
  Avr17
tatataaacctaaccctctgcatgaaggtaccttgtagagggttaggtttatata

SEQ ID NO: 170 - DNA, 56 bp, Artificial sequence
  Avr18
tatataaacctaaccctctagcatgaaggtaccttgtagagggttaggtttatata

SEQ ID NO: 171 - DNA, 57 bp, Artificial sequence
  Avr19
tatataaacctaaccctctagcatgaaggtaccttgtcagagggttaggtttatata

SEQ ID NO: 172 - DNA, 58 bp, Artificial sequence
  Avr20
tatataaacctaaccctcttagcatgaaggtaccttgtcagagggttaggtttatata

SEQ ID NO: 173 - DNA, 59 bp, Artificial sequence
  Avr21
tatataaacctaaccctcttagcatgaaggtaccttgtcgagagggttaggtttatata

SEQ ID NO: 174 - DNA, 60 bp, Artificial sequence
  Avr22
tatataaacctaaccctcttagcatgaaggtaccttgtcgtagagggttaggtttatata

SEQ ID NO: 175 - DNA, 61 bp, Artificial sequence
  Avr23
tatataaacctaaccctctctagcatgaaggtaccttgtcgtagagggttaggtttatata

SEQ ID NO: 176 - DNA, 62 bp, Artificial sequence
  Avr24
tatataaacctaaccctctctagcatgaaggtaccttgtcgttagagggttaggtttatata

SEQ ID NO: 177 - DNA, 63 bp, Artificial sequence
  Avr25
tatataaacctaaccctctactagcatgaaggtaccttgtcgttagagggttaggtttatata

SEQ ID NO: 178 - DNA, 64 bp, Artificial sequence
  Avr26
tatataaacctaaccctctactagcatgaaggtaccttgtcgttgagagggttaggtttatata

SEQ ID NO: 179 - DNA, 65 bp, Artificial sequence
  Avr27
tatataaacctaaccctctcactagcatgaaggtaccttgtcgttgagagggttaggtttatata

SEQ ID NO: 180 - DNA, 66 bp, Artificial sequence
  Avr28
tatataaacctaaccctctcactagcatgaaggtaccttgtcgttgaagagggttaggtttatata

SEQ ID NO: 181 - DNA, 67 bp, Artificial sequence
  Avr29
tatataaacctaaccctctccactagcatgaaggtaccttgtcgttgaagagggttaggtttatata

SEQ ID NO: 182 - DNA, 68 bp, Artificial sequence
  Avr30
tatataaacctaaccctctccactagcatgaaggtaccttgtcgttgatagagggttaggtttatata

SEQ ID NO: 183 - DNA, 69 bp, Artificial sequence
  Avr31
tatataaacctaaccctctaccactagcatgaaggtaccttgtcgttgatagagggttaggtttatata

SEQ ID NO: 184 - DNA, 70 bp, Artificial sequence
  Avr32
tatataaacctaaccctctaccactagcatgaaggtaccttgtcgttgattagagggttaggtttatata

SEQ ID NO: 185 - DNA, 71 bp, Artificial sequence
  Avr33
tatataaacctaaccctctgaccactagcatgaaggtaccttgtcgttgattagagggttaggtttatata

SEQ ID NO: 186 - DNA, 72 bp, Artificial sequence
  Avr34
tatataaacctaaccctctgaccactagcatgaaggtaccttgtcgttgattcagagggttaggtttatata

SEQ ID NO: 187 - DNA, 73 bp, Artificial sequence
  Avr35
tatataaacctaaccctcttgaccactagcatgaaggtaccttgtcgttgattcagagggttaggtttatata

SEQ ID NO: 188 - DNA, 74 bp, Artificial sequence
  Avr36
tatataaacctaaccctcttgaccactagcatgaaggtaccttgtcgttgattcaagagggttaggtttatata

SEQ ID NO: 189 - DNA, 75 bp, Artificial sequence
  Avr37
tatataaacctaaccctctctgaccactagcatgaaggtaccttgtcgttgattcaagagggttaggtttatata

SEQ ID NO: 190 - DNA, 76 bp, Artificial sequence
  Avr38
tatataaacctaaccctctctgaccactagcatgaaggtaccttgtcgttgattcagagagggttaggtttatata

SEQ ID NO: 191 - DNA, 77 bp, Artificial sequence
  Avr39
tatataaacctaaccctcttctgaccactagcatgaaggtaccttgtcgttgattcagagagggttaggtttatata

SEQ ID NO: 192 - DNA, 78 bp, Artificial sequence
  Avr40
tatataaacctaaccctcttctgaccactagcatgaaggtaccttgtcgttgattcagtagagggttaggtttatata

SEQ ID NO: 193 - DNA, 5672 bp, Artificial sequence
  pCLS1853
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcctacacagcggccttgccaccatggccaataccaaatataacaaagagttcctgctgtacctggccggctttgtggacggtgacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccaactacatcttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 194 - DNA, 2850 bp, Artificial sequence
  pCLS8993
atggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactga

SEQ ID NO: 195 - DNA, 2811 bp, Artificial sequence
  pCLS8994
atggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactga

SEQ ID NO: 196 - protein, 1321 aa, Artificial sequence
  pCLS7184
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 197 - protein, 97 aa, Artificial sequence
  I-TevI catalytic domain
MKSGIYQIKNTLNNKVYVGSAKDFEKRWKRHFKDLEKGCHSSIKLQRSFNKHGNVFECSILEEIPYAKDLIIERENFWIKELNSKINGYNIADATFG

SEQ ID NO: 198 - protein, 17 aa, Artificial sequence
  I-TevI deletion-intolerant region
DTCSTHPLKEEIIKKRS

SEQ ID NO: 199 - protein, 49 aa, Artificial sequence
  I-TevI deletion-tolerant region
ETVKAKMLKLGPDGRKALYSKPGSKNGRWNPETHKFCKCGVRIQTSAYT

SEQ ID NO: 200 - protein, 7 aa, Artificial sequence
  I-TevI zinc finger
CSKCRNR

SEQ ID NO: 201 - DNA, 8080 bp, Artificial sequence
  pCLS9021
aaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatataccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatgga

SEQ ID NO: 202 - DNA, 8041 bp, Artificial sequence
  pCLS9022
aaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatataccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatgga

SEQ ID NO: 203 - DNA, 9363 bp, Artificial sequence
  pCLS6615
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 204 - protein, 11 aa, Artificial sequence
  C11 Cter
SIVAQLSRPDP

SEQ ID NO: 205 - protein, 29 aa, Artificial sequence
  C28 Cter
SIVAQLSRPDPALAALTNDHLVALACLGG

SEQ ID NO: 206 - protein, 40 aa, Artificial sequence
  C40 Cter
SIVAQLSRPDPALAALTNDHLVALACLGGRPALDAVKKGL

SEQ ID NO: 207 - protein, 64 aa, Artificial sequence
  C64 Cter
SIVAQLSRPDPALAALTNDHLVALACLGGRPALDAVKKGLPHAPALIKRTNRRIPERTSHRVAD

SEQ ID NO: 208 - protein, 114 aa, Artificial sequence
  C115 Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEAR

SEQ ID NO: 209 - protein, 173 aa, Artificial sequence
  C172 Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGD

SEQ ID NO: 210 - protein, 231 aa, Artificial sequence
  WT Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDP

SEQ ID NO: 211 - protein, 1094 aa, Artificial sequence
  pCLS7821
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 212 - protein, 1110 aa, Artificial sequence
  pCLS7803
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 213 - protein, 1121 aa, Artificial sequence
  pCLS7807
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 214 - protein, 1133 aa, Artificial sequence
  pCLS7809
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 215 - protein, 1157 aa, Artificial sequence
  pCLS7811
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 216 - protein, 1208 aa, Artificial sequence
  pCLS7813
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARTGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 217 - protein, 1264 aa, Artificial sequence
  pCLS7817
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 218 - DNA, 5837 bp, Artificial sequence
  pCLS9012
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 219 - protein, 6 aa, Artificial sequence
  SGGSGS stretch
SGGSGS

SEQ ID NO: 220 - protein, 1164 aa, Xanthomonas spp.
  Original AvrBs3 TALE
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNSGGKQALETVQRLLPVLCQAHGLTPEQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNSGGKQALETVQALLPVLCQAHGLTPEQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 221 - protein, 417 aa, Artificial sequence
  pCLS9937
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 222 - protein, 1001 aa, Artificial sequence
  pCLS9938
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 223 - DNA, 11304 bp, Artificial sequence
  pCLS9924
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcccaagtcccaccattgacagagttaagtccgtctatttcggtacacttactgcttgggaatccttctggtgcaacacccacaaagctaactccagacaattacctgatggtgaagaaccagtatgccttgtcctacaataactccaagggtactgccaattgggttgcttggcaattgaactcctcttggcttggtaatgcggaaagacaggacaatttcagacctgacaaaaccttacctgcaggatgggtaagagttactccatcaatgtattccggatctggttatgatagaggtcatatagctcctagtgctgataggacgaaaactactgaggataatgccgctacctttctgatgacgaacatgatgcctcaaactccagataataaccgtaatacctggggaaacttggaagattactgtagggaattagtctcacaaggtaaagaattgtacattgttgcaggacctaatggctcattaggcaaacccttgaaagggaaagtcactgtgccaaagagtacatggaagattgtggttgttcttgattcaccaggtagtggtttggaaggtataacggcaaacacaagagtgattgctgtcaatatcccaaacgatccggagttgaacaacgattggagagcgtataaggtatcagttgacgaactagaatctttaacaggctatgactttctaagcaatgtatctcccaatatccaaaccagcatagaatcgaaagttgataatgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 224 - DNA, 65 bp, Artificial sequence
  compact target
tatataaacctaaccctcttagcatgaaggtaccttgtcgatggtgtacagtagggggagatgca

SEQ ID NO: 225 - protein, 1166 aa, Artificial sequence
  pCLS9596
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 226 - protein, 1177 aa, Artificial sequence
  pCLS9597
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 227 - protein, 1213 aa, Artificial sequence
  pCLS9599
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 228 - DNA, 24 bp, Artificial sequence
  negative control target
ttgttctcaggtacctcagccaga

SEQ ID NO: 229 - protein, 135 aa, Artificial sequence
  NuiA protein
MTKTNSEILEQLKQASDGLLFMSESEYPFEVFLWEGSAPPVTHEIVLQQTGHGQDAPFKVVDIDSFFSRATTPQDWYEDEENAVVAKFQKLLEVIKSNLKNPQVYRLGEVELDVYVIGETPAGNLAGISTKVVET

SEQ ID NO: 230 - protein, 87 aa, Artificial sequence
  Im7 protein
MELKNSISDYTEAEFVQLLKEIEKENVAATDDVLDVLLEHFVKITEHPDGTDLIYYPSDNRDDSPEGIVKEIKEWRAANGKPGFKQG

SEQ ID NO: 231 - protein, 303 aa, Artificial sequence
  pCLS9939
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 232 - protein, 887 aa, Artificial sequence
  pCLS9940
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 233 - DNA, 10962 bp, Artificial sequence
  pCLS8589
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcaagaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatcctcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 234 - DNA, 3509 bp, Artificial sequence
  pCLS9008
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggcaaacaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 235 - DNA, 4049 bp, Artificial sequence
  pCLS12730
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 236 - DNA, 5801 bp, Artificial sequence
  pCLS12731
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 237 - DNA, 11112 bp, Artificial sequence
  pCLS8522
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 238 - DNA, 61 bp, Artificial sequence
  Avr25RAGT2R
tatataaacctaaccctctactagcatgaaggtaccttgtcgttataagtaaccataaaca

SEQ ID NO: 239 - DNA, 39 bp, Artificial sequence
  CMP_G001
acacgcaaacacaaatacacagcggccttgccaccatgg

SEQ ID NO: 240 - DNA, 37 bp, Artificial sequence
  CMP_G068
ggtatttccggatggaccttgagaatgcttgtggttg

SEQ ID NO: 241 - DNA, 6017 bp, Artificial sequence
  pCLS7763
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccggcgcgcccactatgtgtgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 242 - DNA, 6262 bp, Artificial sequence
  pCLS9922
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatgggatccgaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 243 - DNA, 6406 bp, Artificial sequence
  pCLS9923
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatgggatccaccaagaccaacagcgagattctggaacagctgaaacaggccagcgatggcttgctgttcatgtccgaaagcgagtacccgtttgaagtcttcttgtgggaaggttccgctccaccagtgacccatgagatcgtgttgcagcagactggtcatggccaggatgccccgttcaaagttgtggacatcgactccttctttagcagagccaccactccacaggattggtacgaagatgaagagaacgccgtggttgccaagtttcagaaactgctggaagtcatcaagtccaacctgaagaacccgcaggtgtacagattgggcgaagtcgaactggatgtgtacgtgattggcgagactccggctggcaacctggccggcatcagcaccaaagttgtggagacctgacggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 244 - DNA, 11175 bp, Artificial sequence
  pCLS8590
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 245 - DNA, 17 bp, Artificial sequence
  RagT2-R target
tgtttatggttacttat

SEQ ID NO: 246 - DNA, 17 bp, Artificial sequence
  NptIIT5-L target
tccttgcgcagctgtgc

SEQ ID NO: 247 - DNA, 17 bp, Artificial sequence
  NptIIT5-R target
tagcagccagtcccttc

SEQ ID NO: 248 - DNA, 17 bp, Artificial sequence
  NptIIT6-L target
tgaagcgggaagggact

SEQ ID NO: 249 - DNA, 17 bp, Artificial sequence
  NptIIT6-R target
tgacaggagatcctgcc

SEQ ID NO: 250 - DNA, 49 bp, Artificial sequence
  RagT2.1 target
tatatttaagcacttatatgtgtgtaacaggtataagtaaccataaaca

SEQ ID NO: 251 - DNA, 55 bp, Artificial sequence
  NptIIT5.1 target
tccttgcgcagctgtgctcgacgttgtcactgaagcgggaagggactggctgcta

SEQ ID NO: 252 - DNA, 58 bp, Artificial sequence
  NptIIT6.1 target
tgaagcgggaagggactggctgctattgggcgaagtgccggggcaggatctcctgtca

SEQ ID NO: 253 - protein, 530 aa, Artificial sequence
  RagT2-R RVD insert
LTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALE

SEQ ID NO: 254 - protein, 530 aa, Artificial sequence
  NptIIT5-L RVD insert
LTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALE

SEQ ID NO: 255 - protein, 530 aa, Artificial sequence
  NptIIT5-R RVD insert
LTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALE

SEQ ID NO: 256 - protein, 530 aa, Artificial sequence
  NptIIT6-L RVD insert
LTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALE

SEQ ID NO: 257 - protein, 530 aa, Artificial sequence
  NptIIT6-R RVD insert
LTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALE

SEQ ID NO: 258 - DNA, 9183 bp, Artificial sequence
  TevCreD05 in pCLS6618
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 259 - DNA, 36 bp, Artificial sequence
  CMP_G115
tggtatcggccgatggaccttgtttcaacatcttag

SEQ ID NO: 260 - DNA, 3866 bp, Artificial sequence
  pCLS15775
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 261 - DNA, 5618 bp, Artificial sequence
  pCLS15776
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 262 - DNA, 10929 bp, Artificial sequence
  pCLS12092
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 263 - DNA, 36 bp, Artificial sequence
  CMP_G067
ggtatttccggatggaccttgacctttcatcttgcc

SEQ ID NO: 264 - DNA, 53 bp, Artificial sequence
  CMP_G152
atattttccggagttagatggtttcttacctttcatcttgcctgaaattttgg

SEQ ID NO: 265 - DNA, 36 bp, Artificial sequence
  CMP_G114
ggtatttccggatggaccttgtttcaacatcttagc

SEQ ID NO: 266 - DNA, 4094 bp, Artificial sequence
  pCLS15777
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtaagaaaccatctaactccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 267 - DNA, 4088 bp, Artificial sequence
  pCLS15778
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 268 - DNA, 3869 bp, Artificial sequence
  pCLS15779
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 269 - DNA, 5846 bp, Artificial sequence
  pCLS15780
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtaagaaaccatctaactccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 270 - DNA, 5840 bp, Artificial sequence
  pCLS15781
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 271 - DNA, 1614 bp, Artificial sequence
  RagT2-R RVD insert
gcagcctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgtgatgc

SEQ ID NO: 272 - DNA, 5417 bp, Artificial sequence
  pCLS15782
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 273 - DNA, 11157 bp, Artificial sequence
  pCLS11979
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtaagaaaccatctaactccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 274 - DNA, 11151 bp, Artificial sequence
  pCLS8521
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 275 - DNA, 10728 bp, Artificial sequence
  pCLS12100
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaacaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 276 - DNA, 1614 bp, Artificial sequence
  NptIIT5-L RVD DNA insert
gcagcctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 277 - DNA, 1614 bp, Artificial sequence
  NptIIT5-R RVD DNA insert
gcagcctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 278 - DNA, 1614 bp, Artificial sequence
  NptIIT6-L RVD DNA insert
gcagcctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 279 - DNA, 1614 bp, Artificial sequence
  NptIIT6-R RVD DNA insert
gcagcctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 280 - DNA, 5597 bp, Artificial sequence
  pCLS15783
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 281 - DNA, 5597 bp, Artificial sequence
  pCLS15784
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 282 - DNA, 4440 bp, Artificial sequence
  pCLS14529
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgaccaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgcacgagatctgcaggtcgactctagaggatcccctcgaggcgcgccacacgcaaacacaaatacacagcggccttgccaccatggcaaacaccggtggatcctccggaagatcttcggccgactgataagtcgaccaccaccaccaccaccactgataagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 283 - DNA, 7005 bp, Artificial sequence
  pCLS14579
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgaccaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgcacgagatctgcaggtcgactctagaggatcccctcgaggcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 284 - DNA, 7005 bp, Artificial sequence
  pCLS14581
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgaccaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgcacgagatctgcaggtcgactctagaggatcccctcgaggcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 285 - DNA, 4208 bp, Artificial sequence
  pCLS15785
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaaggaggaaacattcatggaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccaactgatttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtgactgatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 286 - DNA, 5756 bp, Artificial sequence
  pCLS15786
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaaggaggaaacattcatggaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccaactgatttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtgactgatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 287 - DNA, 5756 bp, Artificial sequence
  pCLS15787
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaaggaggaaacattcatggaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccaactgatttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtgactgatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 288 - DNA, 6867 bp, Artificial sequence
  pCLS14584
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgaccaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgcacgagatctgcaggtcgactctagaggatcccctcgaggcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtgactgatcggccgactgataagtcgaccaccaccaccaccaccactgataagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 289 - DNA, 6867 bp, Artificial sequence
  pCLS14587
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcagtgcagcgtgaccaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgcacgagatctgcaggtcgactctagaggatcccctcgaggcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtgactgatcggccgactgataagtcgaccaccaccaccaccaccactgataagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 290 - DNA, 220 bp, Artificial sequence
  TCRB gene region
gccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtaggga

SEQ ID NO: 291 - protein, 349 aa, Artificial sequence
  pCLS6857
MANTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 292 - DNA, 4541 bp, Artificial sequence
  pCLS15788
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 293 - protein, 349 aa, Artificial sequence
  pCLS12083
MANTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETCRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 294 - protein, 349 aa, Artificial sequence
  pCLS12195
MANTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETCRAVLDSLSEKKKSSP

SEQ ID NO: 295 - DNA, 4541 bp, Artificial sequence
  pCLS15789
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaacctgtcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 296 - DNA, 4541 bp, Artificial sequence
  pCLS15790
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagacttgtagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 297 - DNA, 1410 bp, Artificial sequence
  TCRB02A1 RVD
gcagcctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 298 - DNA, 1410 bp, Artificial sequence
  TCRB02A2 RVD
gcagcctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgtgatgc

SEQ ID NO: 299 - DNA, 1410 bp, Artificial sequence
  TCRB02A3  RVD
gcagcctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgtgatgc

SEQ ID NO: 300 - DNA, 5885 bp, Artificial sequence
  pCLS15791
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 301 - DNA, 5885 bp, Artificial sequence
  pCLS15792
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 302 - DNA, 5885 bp, Artificial sequence
  pCLS15793
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 303 - DNA, 5885 bp, Artificial sequence
  pCLS15794
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaacctgtcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 304 - DNA, 10686 bp, Artificial sequence
  pCLS13449
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 305 - DNA, 10686 bp, Artificial sequence
  pCLS13450
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 306 - DNA, 10686 bp, Artificial sequence
  pCLS13451
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 307 - DNA, 10686 bp, Artificial sequence
  pCLS15148
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaacctgtcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 308 - DNA, 10988 bp, Artificial sequence
  pCLS14894
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 309 - DNA, 10988 bp, Artificial sequence
  pCLS14895
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccgacatcaccaaatctaaaatctctgaaaagatgaaaggccagggcccatccggaaataccaaatataacgaagagttcctgctgtacctggccggctttgtggacggtgacggtagcatcgttgctcagattaaaccacatcagtcttgtaagtttaaacatcagctacgtttgacctttaacgtgactcaaaagacccagcgccgttggtttctggacaaactagtggatgaaattggcgttggtcatgtatacgattctggtagcgtttcctactaccagttaagcgaaatcaagccgctgcacaacttcctgactcaactgcagccgtttctggaactgaaacagaaacaggcaaacctggttctgaaaattatcgaacagctgccgtctgcaaaagaatccccggacaaattcctggaagtttgtacctgggtggatcaggttgcagctctgaacgattctaagacgcgtaaaaccacttctgaaaccgttcgtgctgtgctggacagcctgagcgagaagaagaaatcctccccggcggccggtgattcctctgtttctaattccgagcacattgctcctctgtctctgccttcctctcctccatctgttggttctaacaaaaaattcctgctgtatcttgctggatttgtggattctgatggctccatcattgctcagataaaaccaaatcaatcttacaagttcaaacactacctctccttgaccttttgtgtcactcagaagacacaaagaaggtggttcttggacaaattggttgatcgtattggtgtgggctatgtccaggacagaggctctgtgtcagactaccgtctgtctgaaattaagcctcttcgtaactttctcacccaactgcaacccttcttgaagctcaaacagaagcaagcaaatctggttttgaaaatcatcgagcaactgccatctgccaaggagtcccctgacaagtttcttgaagtgtgtacttgggtggatcaggttgctgccttgaatgactccaagaccagaaaaaccacctctgagactgtgagggcagttctggatagcctctctgagaagaaaaagtcctctccttagtaactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 310 - DNA, 6626 bp, Artificial sequence
  pCLS8982
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcctacacagcggccttgccaccatgggttccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgactcctccacagaccggtctggatgttccttactccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcggccgactgataactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 311 - DNA, 23 bp, Artificial sequence
  TRBC2F3 oligonucleotide
gtgggagagaccagagctacctg

SEQ ID NO: 312 - DNA, 24 bp, Artificial sequence
  TRBC2R3B oligonucleotide
ccttactatttgtgtggtcaatgg

SEQ ID NO: 313 - DNA, 22 bp, Artificial sequence
  TRBC2F4 oligonucleotide
aggtacccacctgtccttcctc

SEQ ID NO: 314 - DNA, 23 bp, Artificial sequence
  TRBC2R4B oligonucleotide
atggatgttgtgatgagccttac

SEQ ID NO: 315 - DNA, 41 bp, Artificial sequence
  hybrid RagT2-R/AvrBs5
tgtttatggttacttataggtatatataaacctaaccctct

SEQ ID NO: 316 - DNA, 42 bp, Artificial sequence
  hybrid RagT2-R/AvrBs6
tgtttatggttacttataaggtatatataaacctaaccctct

SEQ ID NO: 317 - DNA, 43 bp, Artificial sequence
  hybrid RagT2-R/AvrBs7
tgtttatggttacttataaggtactatataaacctaaccctct

SEQ ID NO: 318 - DNA, 44 bp, Artificial sequence
  hybrid RagT2-R/AvrBs8
tgtttatggttacttatgaaggtactatataaacctaaccctct

SEQ ID NO: 319 - DNA, 45 bp, Artificial sequence
  hybrid RagT2-R/AvrBs9
tgtttatggttacttatgaaggtacctatataaacctaaccctct

SEQ ID NO: 320 - DNA, 46 bp, Artificial sequence
  hybrid RagT2-R/AvrBs10
tgtttatggttacttattgaaggtacctatataaacctaaccctct

SEQ ID NO: 321 - DNA, 47 bp, Artificial sequence
  hybrid RagT2-R/AvrBs11
tgtttatggttacttattgaaggtaccttatataaacctaaccctct

SEQ ID NO: 322 - DNA, 48 bp, Artificial sequence
  hybrid RagT2-R/AvrBs12
tgtttatggttacttatatgaaggtaccttatataaacctaaccctct

SEQ ID NO: 323 - DNA, 49 bp, Artificial sequence
  hybrid RagT2-R/AvrBs13
tgtttatggttacttatatgaaggtacctttatataaacctaaccctct

SEQ ID NO: 324 - DNA, 50 bp, Artificial sequence
  hybrid RagT2-R/AvrBs14
tgtttatggttacttatcatgaaggtacctttatataaacctaaccctct

SEQ ID NO: 325 - DNA, 51 bp, Artificial sequence
  hybrid RagT2-R/AvrBs15
tgtttatggttacttattagcatgaaggtacctatataaacctaaccctct

SEQ ID NO: 326 - DNA, 52 bp, Artificial sequence
  hybrid RagT2-R/AvrBs16
tgtttatggttacttatgcatgaaggtaccttgtatataaacctaaccctct

SEQ ID NO: 327 - DNA, 53 bp, Artificial sequence
  hybrid RagT2-R/AvrBs17
tgtttatggttacttatgcatgaaggtaccttgttatataaacctaaccctct

SEQ ID NO: 328 - DNA, 54 bp, Artificial sequence
  hybrid RagT2-R/AvrBs18
tgtttatggttacttatagcatgaaggtaccttgttatataaacctaaccctct

SEQ ID NO: 329 - DNA, 55 bp, Artificial sequence
  hybrid RagT2-R/AvrBs19
tgtttatggttacttatagcatgaaggtaccttgtctatataaacctaaccctct

SEQ ID NO: 330 - DNA, 56 bp, Artificial sequence
  hybrid RagT2-R/AvrBs20
tgtttatggttacttattagcatgaaggtaccttgtctatataaacctaaccctct

SEQ ID NO: 331 - DNA, 57 bp, Artificial sequence
  hybrid RagT2-R/AvrBs21
tgtttatggttacttattagcatgaaggtaccttgtcgtatataaacctaaccctct

SEQ ID NO: 332 - DNA, 58 bp, Artificial sequence
  hybrid RagT2-R/AvrBs22
tgtttatggttacttattagcatgaaggtaccttgtcgttatataaacctaaccctct

SEQ ID NO: 333 - DNA, 59 bp, Artificial sequence
  hybrid RagT2-R/AvrBs23
tgtttatggttacttatctagcatgaaggtaccttgtcgttatataaacctaaccctct

SEQ ID NO: 334 - DNA, 60 bp, Artificial sequence
  hybrid RagT2-R/AvrBs24
tgtttatggttacttatctagcatgaaggtaccttgtcgtttatataaacctaaccctct

SEQ ID NO: 335 - DNA, 61 bp, Artificial sequence
  hybrid RagT2-R/AvrBs25
tgtttatggttacttatactagcatgaaggtaccttgtcgtttatataaacctaaccctct

SEQ ID NO: 336 - DNA, 62 bp, Artificial sequence
  hybrid RagT2-R/AvrBs26
tgtttatggttacttatactagcatgaaggtaccttgtcgttgtatataaacctaaccctct

SEQ ID NO: 337 - DNA, 63 bp, Artificial sequence
  hybrid RagT2-R/AvrBs27
tgtttatggttacttatcactagcatgaaggtaccttgtcgttgtatataaacctaaccctct

SEQ ID NO: 338 - DNA, 64 bp, Artificial sequence
  hybrid RagT2-R/AvrBs28
tgtttatggttacttatcactagcatgaaggtaccttgtcgttgatatataaacctaaccctct

SEQ ID NO: 339 - DNA, 65 bp, Artificial sequence
  hybrid RagT2-R/AvrBs29
tgtttatggttacttatccactagcatgaaggtaccttgtcgttgatatataaacctaaccctct

SEQ ID NO: 340 - DNA, 66 bp, Artificial sequence
  hybrid RagT2-R/AvrBs30
tgtttatggttacttatccactagcatgaaggtaccttgtcgttgattatataaacctaaccctct

SEQ ID NO: 341 - DNA, 67 bp, Artificial sequence
  hybrid RagT2-R/AvrBs31
tgtttatggttacttataccactagcatgaaggtaccttgtcgttgattatataaacctaaccctct

SEQ ID NO: 342 - DNA, 68 bp, Artificial sequence
  hybrid RagT2-R/AvrBs32
tgtttatggttacttataccactagcatgaaggtaccttgtcgttgatttatataaacctaaccctct

SEQ ID NO: 343 - DNA, 69 bp, Artificial sequence
  hybrid RagT2-R/AvrBs33
tgtttatggttacttatgaccactagcatgaaggtaccttgtcgttgatttatataaacctaaccctct

SEQ ID NO: 344 - DNA, 70 bp, Artificial sequence
  hybrid RagT2-R/AvrBs34
tgtttatggttacttatgaccactagcatgaaggtaccttgtcgttgattctatataaacctaaccctct

SEQ ID NO: 345 - DNA, 71 bp, Artificial sequence
  hybrid RagT2-R/AvrBs35
tgtttatggttacttattgaccactagcatgaaggtaccttgtcgttgattctatataaacctaaccctct

SEQ ID NO: 346 - DNA, 72 bp, Artificial sequence
  hybrid RagT2-R/AvrBs36
tgtttatggttacttattgaccactagcatgaaggtaccttgtcgttgattcatatataaacctaaccctct

SEQ ID NO: 347 - DNA, 73 bp, Artificial sequence
  hybrid RagT2-R/AvrBs37
tgtttatggttacttatctgaccactagcatgaaggtaccttgtcgttgattcatatataaacctaaccctct

SEQ ID NO: 348 - DNA, 74 bp, Artificial sequence
  hybrid RagT2-R/AvrBs38
tgtttatggttacttatctgaccactagcatgaaggtaccttgtcgttgattcagtatataaacctaaccctct

SEQ ID NO: 349 - DNA, 75 bp, Artificial sequence
  hybrid RagT2-R/AvrBs39
tgtttatggttacttattctgaccactagcatgaaggtaccttgtcgttgattcagtatataaacctaaccctct

SEQ ID NO: 350 - DNA, 76 bp, Artificial sequence
  hybrid RagT2-R/AvrBs40
tgtttatggttacttattctgaccactagcatgaaggtaccttgtcgttgattcagttatataaacctaaccctct

SEQ ID NO: 351 - DNA, 5864 bp, Artificial sequence
  pCLS15795
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 352 - DNA, 6428 bp, Artificial sequence
  pCLS15796
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 353 - DNA, 6362 bp, Artificial sequence
  pCLS15797
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 354 - DNA, 11739 bp, Artificial sequence
  pCLS13299
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 355 - DNA, 11673 bp, Artificial sequence
  pCLS13301
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 356 - DNA, 4967 bp, Artificial sequence
  pCLS15798
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatgggttccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgactcctccacagaccggtctggatgttccttactccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgggaggtggaggttctggaggtggaggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 357 - DNA, 7346 bp, Artificial sequence
  pCLS15799
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatgggttccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgactcctccacagaccggtctggatgttccttactccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgggaggtggaggttctggaggtggaggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 358 - DNA, 10967 bp, Artificial sequence
  pCLS14972
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataagtcgaccaccaccaccaccaccactgataagagctcctcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 359 - DNA, 12449 bp, Artificial sequence
  pCLS14971
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatgggttccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgactcctccacagaccggtctggatgttccttactccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcgggaggtggaggttctggaggtggaggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataagtcgaccaccaccaccaccaccactgataagagctcctcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaac

SEQ ID NO: 360 - DNA, 7997 bp, Artificial sequence
  pCLS15800
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaaggaggaaacattcatggaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccaactgatttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 361 - DNA, 7997 bp, Artificial sequence
  pCLS15801
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaaggaggaaacattcatggaactgaagaactccatcagcgattacaccgaagccgagttcgtgcagctgttgaaagaaattgagaaagagaacgttgctgccaccgatgacgtgctggatgttttgctggaacattttgtgaagatcactgaacatccagatggcactgacctgatctactacccgagcgataaccgtgatgacagcccagaaggcattgttaaagagatcaaagaatggagagctgccaacggcaagccaggcttcaaacagggttgacggccaactgatttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 362 - DNA, 13011 bp, Artificial sequence
  pCLS12106
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 363 - DNA, 13011 bp, Artificial sequence
  pCLS12110
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcgcaaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatccaccggtggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 364 - DNA, 5594 bp, Artificial sequence
  pCLS15802
ggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacat

SEQ ID NO: 365 - DNA, 8588 bp, Artificial sequence
  pCLS8990
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 366 - protein, 582 aa, Artificial sequence
  Colicin-E9
MSGGDGRGHNTGAHSTSGNINGGPTGIGVSGGASDGSGWSSENNPWGGGSGSGIHWGGGSGRGNGGGNGNSGGGSGTGGNLSAVAAPVAFGFPALSTPGAGGLAVSISASELSAAIAGIIAKLKKVNLKFTPFGVVLSSLIPSEIAKDDPNMMSKIVTSLPADDITESPVSSLPLDKATVNVNVRVVDDVKDERQNISVVSGVPMSVPVVDAKPTERPGVFTASIPGAPVLNISVNDSTPAVQTLSPGVTNNTDKDVRPAGFTQGGNTRDAVIRFPKDSGHNAVYVSVSDVLSPDQVKQRQDEENRRQQEWDATHPVEAAERNYERARAELNQANEDVARNQERQAKAVQVYNSRKSELDAANKTLADAIAEIKQFNRFAHDPMAGGHRMWQMAGLKAQRAQTDVNNKQAAFDAAAKEKSDADAALSAAQERRKQKENKEKDAKDKLDKESKRNKPGKATGKGKPVGDKWLDDAGKDSGAPIPDRIADKLRDKEFKSFDDFRKAVWEEVSKDPELSKNLNPSNKSSVSKGYSPFTPKNQQVGGRKVYELHHDKPISQGGEVYDMDNIRVTTPKRHIDIHRGK

SEQ ID NO: 367 - protein, 511 aa, Artificial sequence
  APFL
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 368 - protein, 583 aa, Artificial sequence
  FokI wild-type
MFLSMVSKIRTFGWVQNPGKFENLKRVVQVFDRNSKVHNEVKNIKIPTLVKESKIQKELVAIMNQHDLIYTYKELVGTGTSIRSEAPCDAIIQATIADQGNKKGYIDNWSSDGFLRWAHALGFIEYINKSDSFVITDVGLAYSKSADGSAIEKEILIEAISSYPPAIRILTLLEDGQHLTKFDLGKNLGFSGESGFTSLPEGILLDTLANAMPKDKGEIRNNWEGSSDKYARMIGGWLDKLGLVKQGKKEFIIPTLGKPDNKEFISHAFKITGEGLKVLRRAKGSTKFTRVPKRVYWEMLATNLTDKEYVRTRRALILEILIKAGSLKIEQIQDNLKKLGFDEVIETIENDIKGLINTGIFIEIKGRFYQLKDHILQFVIPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 369 - protein, 86 aa, Artificial sequence [sequence omitted]

SEQ ID NO: 370 - protein, 1076 aa, Artificial sequence
  pCLS9082
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPSGGSGSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQHLRKSEAQAKKEKLNIWSEDNADSGQAAD

SEQ ID NO: 371 - protein, 1088 aa, Artificial sequence
  pCLS9081
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPSGGSGSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQHLRKSEAQAKKEKLNIWSEDNADSGQAAD

SEQ ID NO: 372 - protein, 15 aa, Artificial sequence
  Linker_TAL1
SGGSGSNVGSGSGSG

SEQ ID NO: 373 - protein, 20 aa, Artificial sequence
  Linker_TAL2
SGGSGSLTTNLTAFSGSGSG

SEQ ID NO: 374 - protein, 22 aa, Artificial sequence
  Linker_TAL3
SGGSGSKRRTTISIAASGSGSG

SEQ ID NO: 375 - protein, 17 aa, Artificial sequence
  Linker_TAL4
SGGSGSVGRQPSGSGSG

SEQ ID NO: 376 - protein, 26 aa, Artificial sequence
  Linker_TAL5
SGGSGSYTRLPERSELPAEISGSGSG

SEQ ID NO: 377 - protein, 38 aa, Artificial sequence
  Linker_TAL6
SGGSGSIVVLNRAETPLPLDPTGKVKAELDTRSGSGSG

SEQ ID NO: 378 - protein, 21 aa, Artificial sequence
  Linker_TAL7
SGGSGSTATPPGSVTSGSGSG

SEQ ID NO: 379 - protein, 21 aa, Artificial sequence
  Linker_TAL8
SGGSGSLDNFINRPVSGSGSG

SEQ ID NO: 380 - protein, 21 aa, Artificial sequence
  Linker_TAL9
SGGSGSVSSAKTTAPSGSGSG

SEQ ID NO: 381 - protein, 22 aa, Artificial sequence
  Linker_TAL10
SGGSGSDSKAPNASNLSGSGSG

SEQ ID NO: 382 - protein, 23 aa, Artificial sequence
  Linker_TAL11
SGGSGSPVKMFDRHSSLSGSGSG

SEQ ID NO: 383 - protein, 23 aa, Artificial sequence
  Linker_TAL12
SGGSGSAPAETKAEPMTSGSGSG

SEQ ID NO: 384 - protein, 26 aa, Artificial sequence
  Linker_TAL13
SGGSGSVSTDSTPVTNQKSSSGSGSG

SEQ ID NO: 385 - protein, 16 aa, Artificial sequence
  Linker_TAL14
SGGSGSDSVISGSGSG

SEQ ID NO: 386 - protein, 33 aa, Artificial sequence
  Linker_TAL15
SGGSGSARFTLAVGDNRVLDMASTYFDSGSGSG

SEQ ID NO: 387 - protein, 17 aa, Artificial sequence
  Linker_TAL16
SGGSGSLQENLSGSGSG

SEQ ID NO: 388 - protein, 19 aa, Artificial sequence
  Linker_TAL17
SGGSGSGYTYINPSGSGSG

SEQ ID NO: 389 - protein, 26 aa, Artificial sequence
  Linker_TAL18
SGGSGSYKLPAVTTMKVRPASGSGSG

SEQ ID NO: 390 - protein, 16 aa, Artificial sequence
  Linker_TAL19
SGGSGSLEGSSGSGSG

SEQ ID NO: 391 - protein, 16 aa, Artificial sequence
  Linker_TAL20
SGGSGSIVEASGSGSG

SEQ ID NO: 392 - protein, 18 aa, Artificial sequence
  Linker_TAL21
SGGSGSQTYQPASGSGSG

SEQ ID NO: 393 - protein, 27 aa, Artificial sequence
  Linker_TAL22
SGGSGSIARTDLKKNRDYPLASGSGSG

SEQ ID NO: 394 - protein, 18 aa, Artificial sequence
  Linker_TAL23
SGGSGSLPEEKGSGSGSG

SEQ ID NO: 395 - protein, 16 aa, Artificial sequence
  Linker_TAL24
SGGSGSYTSTSGSGSG

SEQ ID NO: 396 - protein, 20 aa, Artificial sequence
  Linker_TAL25
SGGSGSSRPSESEGSGSGSG

SEQ ID NO: 397 - protein, 17 aa, Artificial sequence
  Linker_TAL26
SGGSGSLGNSLSGSGSG

SEQ ID NO: 398 - protein, 19 aa, Artificial sequence
  Linker_TAL27
SGGSGSLTKYKSSSGSGSG

SEQ ID NO: 399 - protein, 33 aa, Artificial sequence
  Linker_TAL28
SGGSGSTEEPGAPLTTPPTLHGNQARASGSGSG

SEQ ID NO: 400 - protein, 18 aa, Artificial sequence
  Linker_TAL29
SGGSGSFSHSTTSGSGSG

SEQ ID NO: 401 - protein, 20 aa, Artificial sequence
  Linker_TAL30
SGGSGSPELKQKSSSGSGSG

SEQ ID NO: 402 - protein, 40 aa, Artificial sequence
  Linker_TAL31
SGGSGSILNKEKKAVSPLLLTTTNSSEGLSMGNYSGSGSG

SEQ ID NO: 403 - protein, 31 aa, Artificial sequence
  Linker_TAL32
ELAEFHARYADLLLRDLRERPVSLVRGPDSG

SEQ ID NO: 404 - protein, 31 aa, Artificial sequence
  Linker_TAL33
ELAEFHARPDPLLLRDLRERPVSLVRGLGSG

SEQ ID NO: 405 - protein, 26 aa, Artificial sequence
  Linker_TAL34
ELAEFHARYADLLLRDLRERSGSGSG

SEQ ID NO: 406 - protein, 31 aa, Artificial sequence
  Linker_TAL35
DIFDYYAGVAEVMLGHIAGRPATRKRWPNSG

SEQ ID NO: 407 - protein, 31 aa, Artificial sequence
  Linker_TAL36
DIFDYYAGPDPVMLGHIAGRPATRKRWLGSG

SEQ ID NO: 408 - protein, 26 aa, Artificial sequence
  Linker_TAL37
DIFDYYAGVAEVMLGHIAGRSGSGSG

SEQ ID NO: 409 - protein, 37 aa, Artificial sequence
  Linker A
SIVAQLSRPDPALVSFQKLKLACLGGRPALDAVKKGL

SEQ ID NO: 410 - protein, 37 aa, Artificial sequence
  Linker B
SIVAQLSRPDPAAVSAQKAKAACLGGRPALDAVKKGL

SEQ ID NO: 411 - protein, 37 aa, Artificial sequence
  Linker C
SIVAQLSRPDPAVVTFHKLKLACLGGRPALDAVKKGL

SEQ ID NO: 412 - protein, 44 aa, Artificial sequence
  Linker D
SIVAQLSRPDPAQSLAQELSLNESQIKIACLGGRPALDAVKKGL

SEQ ID NO: 413 - protein, 40 aa, Artificial sequence
  Linker E
SIVAQLSRPDPALQLPPLERLTLDACLGGRPALDAVKKGL

SEQ ID NO: 414 - protein, 38 aa, Artificial sequence
  Linker F
SIVAQLSRPDPAIHKKFSSIQMACLGGRPALDAVKKGL

SEQ ID NO: 415 - protein, 40 aa, Artificial sequence
  Linker G
SIVAQLSRPDPAAAAATNDHAVAAACLGGRPALDAVKKGL

SEQ ID NO: 416 - protein, 1044 aa, Artificial sequence
  Linker385_ColE7
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGGSGSDSVISGSGSGDPSGGSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKAA

SEQ ID NO: 417 - protein, 1047 aa, Artificial sequence
  Linker388_ColE7
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGGSGSGYTYINPSGSGSGDPSGGSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKAA

SEQ ID NO: 418 - protein, 1046 aa, Artificial sequence
  Linker394_ColE7
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGGSGSLPEEKGSGSGSGDPSGGSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKAA

SEQ ID NO: 419 - protein, 1046 aa, Artificial sequence
  Linker400_ColE7
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGGSGSFSHSTTSGSGSGDPSGGSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKAA

SEQ ID NO: 420 - protein, 365 aa, Artificial sequence
  cT11_TevD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSAD

SEQ ID NO: 421 - protein, 352 aa, Artificial sequence
  cT11_TevD02
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSAD

SEQ ID NO: 422 - protein, 292 aa, Artificial sequence
  cT11_TevD05
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKQGPSAD

SEQ ID NO: 423 - protein, 949 aa, Artificial sequence
  cT11Avr_TevD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSAD

SEQ ID NO: 424 - protein, 936 aa, Artificial sequence
  cT11Avr_TevD02
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSAD

SEQ ID NO: 425 - protein, 876 aa, Artificial sequence
  cT11Avr_TevD05
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKQGPSAD

SEQ ID NO: 426 - protein, 368 aa, Artificial sequence
  TevW01_cT11
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGKKPSNSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 427 - protein, 366 aa, Artificial sequence
  TevD01_cT11
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 428 - protein, 353 aa, Artificial sequence
  TevD02_cT11
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 429 - protein, 293 aa, Artificial sequence
  TevD05_cT11
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 430 - protein, 952 aa, Artificial sequence
  TevW01_cT11Avr
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGKKPSNSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSAD

SEQ ID NO: 431 - protein, 950 aa, Artificial sequence
  TevD01_cT11Avr
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISGKMKGQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSAD

SEQ ID NO: 432 - protein, 937 aa, Artificial sequence
  TevD02_cT11Avr
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSAD

SEQ ID NO: 433 - protein, 417 aa, Artificial sequence; identical to SEQ ID NO: 221
  cT11_NucA

SEQ ID NO: 434 - protein, 1001 aa, Artificial sequence; identical to SEQ ID NO: 222
  cT11Avr_NucA

SEQ ID NO: 435 - protein, 303 aa, Artificial sequence; identical to SEQ ID NO: 231
  cT11_ColE7

SEQ ID NO: 436 - protein, 887 aa, Artificial sequence; identical to SEQ ID NO: 232
  cT11Avr_ColE7

SEQ ID NO: 437 - protein, 819 aa, Artificial sequence
  cT11NptIIT5-L_ColE7_A497_CFS1
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRAKFWEEVSKDPELSKQFSRNNNDRMKVGKAPKTRTQDVSGKRTSFELHHEKPISQNGGVYDMDNISVVTPKRHIDIHRGKGSTGD

SEQ ID NO: 438 - protein, 819 aa, Artificial sequence
  cT11NptIIT6-L_ColE7_A497_CFS1
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRAKFWEEVSKDPELSKQFSRNNNDRMKVGKAPKTRTQDVSGKRTSFELHHEKPISQNGGVYDMDNISVVTPKRHIDIHRGKGSTGD

SEQ ID NO: 439 - protein, 529 aa, Artificial sequence
  cT11_scTB2aD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 440 - protein, 529 aa, Artificial sequence
  cT11_scTB2aD01_148C
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETCRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 441 - protein, 529 aa, Artificial sequence
  cT11_scTB2aD01_333C
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETCRAVLDSLSEKKKSSP

SEQ ID NO: 442 - protein, 349 aa, Artificial sequence; identical to SEQ ID NO: 293
  TCRB02-A-V148C

SEQ ID NO: 443 - protein, 349 aa, Artificial sequence; identical to SEQ ID NO: 294
  TCRB02-A-V333C

SEQ ID NO: 444 - protein, 977 aa, Artificial sequence
  cT11TB2A1_scTB2aD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 445 - protein, 977 aa, Artificial sequence
  cT11TB2A2_scTB2aD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 446 - protein, 977 aa, Artificial sequence
  cT11TB2A3_scTB2aD01
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETVRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 447 - protein, 1146 aa, Artificial sequence
  TevD02_cT11Avr_FokI-L
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSSGPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGSSAD

SEQ ID NO: 448 - protein, 1124 aa, Artificial sequence
  TevD02_cT11Avr_TevD02
MAKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSQGPSAD

SEQ ID NO: 449 - protein, 1146 aa, Artificial sequence; identical to SEQ ID NO: 447
  TevD02_cT11Avr_FokI-L

SEQ ID NO: 450 - protein, 1124 aa, Artificial sequence; identical to SEQ ID NO: 448
  TevD02_cT11Avr_TevD02

SEQ ID NO: 451 - protein, 659 aa, Artificial sequence
  scTrex2_cT11
MGSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEATPPQTGLDVPYSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEAGGGGSGGGGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 452 - protein, 1452 aa, Artificial sequence [sequence omitted]

SEQ ID NO: 453 - protein, 1570 aa, Artificial sequence
  cT11Avr_ColE7_A497_cT11RagT2-R
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRAKFWEEVSKDPELSKQFSRNNNDRMKVGKAPKTRTQDVSGKRTSFELHHEKPISQNGGVYDMDNISVVTPKRHIDIHRGKGSTGGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSAD

SEQ ID NO: 454 - protein, 1570 aa, Artificial sequence
  cT11RagT2-R_ColE7_A497_cT11Avr
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRAKFWEEVSKDPELSKQFSRNNNDRMKVGKAPKTRTQDVSGKRTSFELHHEKPISQNGGVYDMDNISVVTPKRHIDIHRGKGSTGGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSAD

SEQ ID NO: 455 - protein, 977 aa, Artificial sequence
  cT11TB2A2_scTB2aD01_148C
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALESIVAQLSRPDPGSDITKSKISEKMKGQGPSGNTKYNEEFLLYLAGFVDGDGSIVAQIKPHQSCKFKHQLRLTFNVTQKTQRRWFLDKLVDEIGVGHVYDSGSVSYYQLSEIKPLHNFLTQLQPFLELKQKQANLVLKIIEQLPSAKESPDKFLEVCTWVDQVAALNDSKTRKTTSETCRAVLDSLSEKKKSSPAAGDSSVSNSEHIAPLSLPSSPPSVGSNKKFLLYLAGFVDSDGSIIAQIKPNQSYKFKHYLSLTFCVTQKTQRRWFLDKLVDRIGVGYVQDRGSVSDYRLSEIKPLRNFLTQLQPFLKLKQKQANLVLKIIEQLPSAKESPDKFLEVCTWVDQVAALNDSKTRKTTSETVRAVLDSLSEKKKSSP

SEQ ID NO: 456 - DNA, 24 bp, Artificial Sequence
  Description of Artificial Sequence: Synthetic oligonucleotide
gatggccatggtaagcaggagggc

SEQ ID NO: 457 - DNA, 15 bp, Artificial Sequence
  Description of Artificial Sequence: Synthetic oligonucleotide
tgctggtcagcgccc

SEQ ID NO: 458 - DNA, 15 bp, Artificial Sequence
  Description of Artificial Sequence: Synthetic oligonucleotide
tgctgtgctggtcag

SEQ ID NO: 459 - DNA, 15 bp, Artificial Sequence
  Description of Artificial Sequence: Synthetic oligonucleotide
tgtatgctgtgctgg

SEQ ID NO: 460 - protein, 28 aa, Artificial Sequence
  Description of Artificial Sequence: Synthetic peptide
NNHDNGNNNNNGHDNINNHDNNHDHDNG

SEQ ID NO: 461 - protein, 28 aa, Artificial Sequence
  Description of Artificial Sequence: Synthetic peptide
NNHDNGNNNGNNHDNGNNNNNGHDNING

SEQ ID NO: 462 - protein, 28 aa, Artificial Sequence
  Description of Artificial Sequence: Synthetic peptide
NNNGNINGNNHDNGNNNGNNHDNGNNNG

SEQ ID NO: 463 - DNA, 220 bp, Artificial Sequence; identical to SEQ ID NO: 290
  Description of Artificial Sequence: Synthetic polynucleotide

SEQ ID NO: 464 - DNA, 24 bp, Artificial Sequence
  Description of Artificial Sequence: Synthetic oligonucleotide
gatggccatggtaagcaggagggc

SEQ ID NO: 465 - DNA, 46 bp, Artificial Sequence
  Description of Artificial Sequence: Synthetic oligonucleotide
tgctggtcagcgcccttggtttgatggccatggtaagcaggagggc

SEQ ID NO: 466 - DNA, 51 bp, Artificial Sequence
  Description of Artificial Sequence: Synthetic oligonucleotide
tgctgtgctggtcagcgcccttgtgttgatggccatggtaagcaggagggc

SEQ ID NO: 467 - DNA, 55 bp, Artificial Sequence
  Description of Artificial Sequence: Synthetic oligonucleotide
tgtatgctgtgctggtcagcgcccttgtgttgatggccatggtaagcaggagggc

SEQ ID NO: 468 - protein, 4 aa, Artificial Sequence
  Description of Artificial Sequence: Synthetic peptide
GSSG

SEQ ID NO: 469 - protein, 5 aa, Artificial Sequence
  Description of Artificial Sequence: Synthetic peptide
QGPSG

SEQ ID NO: 470 - DNA, 25 bp, Artificial Sequence
  Description of Artificial Sequence: PthXo1 RVD
tgcatctccccctactgtacaccac

The invention claimed is:

1. A method for targeting and detecting processing of a double-stranded DNA, comprising:
    (a) selecting a DNA target sequence of interest in a primary human cell culture on one strand of a double-stranded DNA;
    (b) providing a compact Transcription Activator-Like Effector Nuclease (TALEN) monomer comprising:
        (i) one core TALE scaffold comprising Repeat Variable Dipeptide regions (RVDs) designed to target a binding site on said DNA target sequence of interest; and
        (ii) at least one engineered single chain meganuclease variant comprising at least two LAGLIDADG homing endonuclease core domains designed to target a binding site on said DNA target sequence of interest, wherein the single chain meganuclease variant is fused to the C- and/or N-terminus of said core TALE scaffold; and
    wherein the targeted binding site of the TALE DNA scaffold and the targeted binding site of the meganuclease variant homing endonuclease core domains are separated by 12-40 bases;
    (c) contacting said DNA target sequence in the primary human cell culture with said compact TALEN monomer; and
    (d) detecting cleavage at the DNA target sequence of interest in the cell culture.

2. The method of claim 1, wherein said single chain meganuclease variant is fused to the C-terminus of said core TALE scaffold.

3. The method of claim 1, wherein said single chain meganuclease variant is fused to the N-terminus of said core TALE scaffold.

4. The method of claim 1, wherein said single chain meganuclease variant has at least 95% sequence identity with SEQ ID NO: 1.

5. The method of claim 1, wherein said core TALE scaffold comprises a protein sequence having at least 90% amino acid sequence identity with a protein sequence selected from the group consisting of SEQ ID NO: 134 and SEQ ID NO: 135.

6. The method of claim 1, wherein said core TALE scaffold comprises a protein sequence having at least 90% amino acid sequence identity with a protein sequence selected from the group consisting of SEQ ID NO: 136 to SEQ ID NO: 139.

7. The method of claim 1, wherein said compact TALEN monomer is transiently expressed in the cell culture.

8. The method of claim 1, wherein said cell culture is a human primary T cell population.

9. The method of claim 8, wherein said compact TALEN is designed to target a sequence in a T cell receptor gene.

10. The method of claim 1, wherein said compact TALEN monomer comprises a protein sequence having at least 90% amino acid sequence identity with a protein sequence selected from the group of SEQ ID NO: 444-446.

11. The method of claim 1, wherein said single chain meganuclease variant is fused to the C-terminus of said core TALE scaffold with a peptide linker.

12. The method of claim 1, wherein the DNA target sequence of interest comprises SEQ ID NO: 290.

13. A method for targeting and detecting processing of a double-stranded DNA, comprising:
    (a) selecting one DNA target sequence of interest in a cell culture on one strand of a double-stranded DNA encoding a T cell receptor gene comprising SEQ ID NO: 290;
    (b) providing a compact TALEN monomer comprising:
        (i) one core TALE scaffold comprising Repeat Variable Dipeptide regions (RVDs) designed to target a binding site on said DNA target sequence of interest; and
        (ii) at least one engineered single chain CreI meganuclease variant that has at least 90% identity with SEQ ID NO:291 and is designed to target a binding site on said DNA target sequence of interest fused to the C- and/or N-terminus of said core TALE scaffold; and
    wherein the targeted binding site of the TALE DNA binding domain and the targeted binding site of the meganuclease variant binding domain are separated by 12-40 bases;
    (c) contacting said DNA target sequence in the cell culture with said compact TALEN monomer; and
    (d) detecting cleavage of the T cell receptor gene within SEQ ID NO: 290 in the cell culture.

14. The method of claim 13, wherein said single chain meganuclease variant is fused to the C-terminus of said core TALE scaffold.

15. The method of claim 13, wherein said single chain meganuclease variant is fused to the N-terminus of said core TALE scaffold.

16. The method of claim 13, wherein said single chain meganuclease variant has at least 95% sequence identity with SEQ ID NO: 1.

17. The method of claim 13, wherein said core TALE scaffold comprises a protein sequence having at least 80% amino acid sequence identity with a protein sequence selected from the group consisting of SEQ ID NO: 134 and SEQ ID NO: 135.

18. The method of claim 13, wherein said core TALE scaffold comprises a protein sequence having at least 80% amino acid sequence identity with a protein sequence selected from the group consisting of SEQ ID NO: 136 to SEQ ID NO: 139.

19. The method of claim 13, wherein said compact TALEN monomer is transiently expressed in the cell culture.

20. The method of claim 13, wherein said human primary cell culture is a human primary T cell culture.

21. The method of claim 13, wherein said compact TALEN monomer comprises a protein sequence having at least 90% amino acid sequence identity with a protein sequence selected from the group of SEQ ID NO: 444-446.

22. The method of claim 13, wherein said single chain meganuclease variant is fused to the C-terminus of said core TALE scaffold with a peptide linker.

* * * * *